United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 94

SEQ ID NO: 4191918 - RNA, 56 nt, Human
ccucugcucugguccaugugcuaggcuguggagguuugcaggccaggaggcggagg

SEQ ID NO: 4191919 - RNA, 99 nt, Human
ccucugcugugggugcuugcuucucacaugcaccugagccacacugcugccccgugcuggcagaggugcaugaugcagagugcagccuccagagauagg

SEQ ID NO: 4191920 - RNA, 71 nt, Human
ccucuggacacugcuuuagccuugacagagacagucaguguugcugcagggaccacaagcagguugugggg

SEQ ID NO: 4191921 - RNA, 55 nt, Human
ccucuggaucuguccccuuuuuguugucucugagcuaaugggacagauuccaugg

SEQ ID NO: 4191922 - RNA, 55 nt, Human
ccucuggaucuuucuccacacucuucugaggugugcaguagagaaagagcagggg

SEQ ID NO: 4191923 - RNA, 56 nt, Human
ccucuggcauagcaaguggccucuacauggugugaaggucaaaggcauccaugagg

SEQ ID NO: 4191924 - RNA, 60 nt, Human
ccucuggccauucuuugauggaguugagaaauaugaccacaauuacagauggcucagggg

SEQ ID NO: 4191925 - RNA, 62 nt, Human
ccucuggggcaucagacaaagguacaacuauagaaagccuuaauccugagaguccuaugagg

SEQ ID NO: 4191926 - RNA, 66 nt, Human
ccucuggggguccucagagucugggcacauaucuauaucucgcccuggacugugggcuccaggagg

SEQ ID NO: 4191927 - RNA, 69 nt, Human
ccucugggucucccugaggcuaaaccccuucagugucugaaguccggcuugccccaggcaguccagggg

SEQ ID NO: 4191928 - RNA, 84 nt, Human
ccucuggugugaccuucagcaaucuuucuuggucuucuagccagauacagaggacaaaaugagaagugcuuggguccccagagg

SEQ ID NO: 4191929 - RNA, 80 nt, Human
ccucuguaagguuuccgaaaucaaacuugggcuucuggcuagccuuuucuaggucuugauuuuucagugcuuuccagagg

SEQ ID NO: 4191930 - RNA, 74 nt, Human
ccucugucccucugugucccugcagucccucuugccuccaggcgauggcagcagaagacaaggagucccagagg

SEQ ID NO: 4191931 - RNA, 69 nt, Human
ccucuguguauccaaguucagguggccauagggcacgguggacaccaugaauaguggguguaugagggg

SEQ ID NO: 4191932 - RNA, 99 nt, Human
ccugaaaaauagacaguauuugacauugaaagcagaaucgcccuggaugacuccaccagcacaucugacuuccagugcaggagcugucugagauuuagg

SEQ ID NO: 4191933 - RNA, 62 nt, Human
ccugaacugagauuacaagagacauuuugaaauacaaaaguuucugucuucucaguggcagg

SEQ ID NO: 4191934 - RNA, 58 nt, Human
ccugaagcaguaucccagaagguccacccccguaccuucuuauaagauaggccucagg

SEQ ID NO: 4191935 - RNA, 82 nt, Human
ccugaaguccucuauuuuggucucauugcuccucuuucucagcuccuaaagcaguuuggaccucugcuagauggaccauagg

SEQ ID NO: 4191936 - RNA, 69 nt, Human
ccugaagucuccaauguugugcugagcccaaggguucucuggcuguggcugacauugcagacacucagg

SEQ ID NO: 4191937 - RNA, 79 nt, Human
ccugaauggaaaauggaggcccaggccccuccauggaaucuguucuccaauagaggagcuuuggacucccccagucugg

SEQ ID NO: 4191938 - RNA, 73 nt, Human
ccugacacaguggcucgugcuuguaaugccagcacuuugggaggcugaggcaggcagaucacuugaggucagg

SEQ ID NO: 4191939 - RNA, 70 nt, Human
ccugacaccgcgccugcgauuucagacuguuuaauuaauucugauaauaccacaucgcaggugcugcagg

SEQ ID NO: 4191940 - RNA, 77 nt, Human
ccugacagccugaggcuucuguaacccuguccuagggaccccgugaaggauaggggcagggagcagggcuggacagg

SEQ ID NO: 4191941 - RNA, 104 nt, Human
ccugacauuguuguaauaaccccucuucaggagcugaaagccugccagccucccugaggcagcagucaguucucugacugauuggauaugaccuguguguuagg

SEQ ID NO: 4191942 - RNA, 69 nt, Human
ccugacccaggggcagccuugcugugggagcuauuuccaaggacaacccuggcagccccaggguacggg

SEQ ID NO: 4191943 - RNA, 79 nt, Human
ccugaccccggccauuggagcguggggggcagccuuugcagagggguguccuuugggggcuccgaggagcuggggaggg

SEQ ID NO: 4191944 - RNA, 120 nt, Human
ccugaccucgugaugugcccgacucggccucccaaagugcuaggauuacaggcgugaaccaccgugccuggccaauuuuuguauuuuuaguagagaugggguuuuaucauguuggccagg

SEQ ID NO: 4191945 - RNA, 107 nt, Human
ccugaccuucucccuggugccccuuuagccccugcagagacuucugccuuucccuaggauacaugguugcuggggguggcagagcuagaaccaggguggugggaagg

SEQ ID NO: 4191946 - RNA, 85 nt, Human
ccugacuguaucauccaaggaggcuuugacguccauuugguuuacccccagauuugcaaggguugccuuggaaaucucaguuggg

SEQ ID NO: 4191947 - RNA, 60 nt, Human
ccugagaauuacucugaugaguaauuacugcccccuuacuccauucagaaauuacuuagg

SEQ ID NO: 4191948 - RNA, 86 nt, Human
ccugagcaagagcaggaugagccgcgcaagcugacagccacugcugccgcccgcgcccaggcucggucucgcucccagcgcucggg

SEQ ID NO: 4191949 - RNA, 56 nt, Human
ccugagcauguaugucacccuccccacuaagucuaggguuggcaagacagcucagg

SEQ ID NO: 4191950 - RNA, 65 nt, Human
ccugagccacugugguccucccaugauaugaacagagucugucguggagcucacagugugccagg

SEQ ID NO: 4191951 - RNA, 56 nt, Human
ccugagcccaggaaugcacuucagcuccugguugagcaaugucacugaggcuuggg

SEQ ID NO: 4191952 - RNA, 65 nt, Human
ccugagcccucuucccuagugaucgggacugcugcaggaucugguucuggggaaggggguugggg

SEQ ID NO: 4191953 - RNA, 57 nt, Human
ccugagcccuugaacccaaguccucagaaaugagcagacacuugaggugggcuuugg

SEQ ID NO: 4191954 - RNA, 63 nt, Human
ccugagccugaguggugcagggcagcaggcgucuuauuaugcucccaaaccaugugggccagg

SEQ ID NO: 4191955 - RNA, 106 nt, Human
ccugagcgagaguaacauacaguaaaaauaaagacuaaacaaccaauaucuugagagcugagggauuuuuguguguuuguuuugaagcuuguuuauuuuugacagg

SEQ ID NO: 4191956 - RNA, 55 nt, Human
ccugagcuggagacauuacauauuagaaauaauaguaaguuuugauagcauuagg

SEQ ID NO: 4191957 - RNA, 58 nt, Human
ccugagcuggcagugaccuggaacccgaugagggcgugggugacacaucagcgucagg

SEQ ID NO: 4191958 - RNA, 69 nt, Human
ccugagcuguccucuuggacucagggcugcggugcugugaccagcccauccauggaggccagccgcagg

SEQ ID NO: 4191959 - RNA, 67 nt, Human
ccugaggaaauuguaaugacuucacuugaggcagcugccuuggaagacaaugcugauucucuucagg

SEQ ID NO: 4191960 - RNA, 59 nt, Human
ccugaggagagaauugcuccuguccuuuccuauaucacagggcauugcuggccucgagg

SEQ ID NO: 4191961 - RNA, 130 nt, Human
ccugaggcaagugaggcccugccccugggguggcugauuuuguccugggggugggaggggcuggaggggaauccaguccaaccugccccuugggcccuauagccucaaagggguggggagagcagacagg

SEQ ID NO: 4191962 - RNA, 61 nt, Human
ccugaggcaugggaaguugggugucuucucaaaggucguucacuuugcucccugcuucugg

SEQ ID NO: 4191963 - RNA, 88 nt, Human
ccugaggcuuaguggauagugguccccucgacagaagcuggaggguccugcaccugcugagggauagcugcucacuggcacacucagg

SEQ ID NO: 4191964 - RNA, 56 nt, Human
ccugagggaacaugcacccaauugcccuguugggagagugggccauucccucaagg

SEQ ID NO: 4191965 - RNA, 69 nt, Human
ccugagggaugccugguuuguuuucccucaugaauaauaccuuucagaagcacagaccagaucuccagg

SEQ ID NO: 4191966 - RNA, 56 nt, Human
ccugagggugcaugugugcacguaugcacauguguguguccauucgcacucuuagg

SEQ ID NO: 4191967 - RNA, 65 nt, Human
ccugagguggcugcagcacugcccuggcuuccagaaagcucucgagcaugcugggucuccucagg

SEQ ID NO: 4191968 - RNA, 57 nt, Human
ccugaguaccugccagugagugaacucuccagagcuuucaucuggccguauuccagg

SEQ ID NO: 4191969 - RNA, 94 nt, Human
ccugagucacuauuuuucugauuucucuuguggaugcuacuuucuaguuuaauaggaaagaaguuagauuguuauauggaaugguuaucucagg

SEQ ID NO: 4191970 - RNA, 60 nt, Human
ccugagugaauucccucacugucugcuucccuugccaacaucagaguuaguucaaucagg

SEQ ID NO: 4191971 - RNA, 67 nt, Human
ccugagugauugcccaagaguuaagucucugcuccuggggagcagggauguguacuugguaagcagg

SEQ ID NO: 4191972 - RNA, 88 nt, Human
ccugagugccugggagagggucagagacugggcagagcuuucuaaaucacuguaaggacuuuggcuuuuauucuagguaauacugagg

SEQ ID NO: 4191973 - RNA, 90 nt, Human
ccugaguuuuaauaugagcucugacacugacuagccgugugacuauggucaaggcacuucaugucucaguuuucucauuuguaauuuggg

SEQ ID NO: 4191974 - RNA, 81 nt, Human
ccugauaagauccaagggcugcuuuuuguauaugcuucgaggaugagcccauucucuguacagaagguaccguucauuagg

SEQ ID NO: 4191975 - RNA, 69 nt, Human
ccugaucccuuggucagaugguucugagcuguuuaagugcugagugucaacugucuacagggagccagg

SEQ ID NO: 4191976 - RNA, 92 nt, Human
ccugaugagaagacuguuuguauucauaaauaaucuguaguuguuuuagucuuauuuuccagaagcagguauuucauggagcaagcagcagg

SEQ ID NO: 4191977 - RNA, 72 nt, Human
ccugauggauguuuggauguuuccuguuuuuagguaauaugaauaaggcugcuauaaacauucccguacagg

SEQ ID NO: 4191978 - RNA, 91 nt, Human
ccugauggugcucacagggccagcagcuuggccaaccuuggggagcugugccagaggcuggacuuucugcugggcuccgugguccaugagg

SEQ ID NO: 4191979 - RNA, 62 nt, Human
ccugaugugugcagggcagccgaaugggcuuccaggaagccaacuccagccccugcagcagg

SEQ ID NO: 4191980 - RNA, 78 nt, Human
ccugcaaacuacauuucccagcugccuuccuguuagagucagccaagagggggcacugggaggagauggaaaagcagg

SEQ ID NO: 4191981 - RNA, 67 nt, Human
ccugcaacagcucagacacgggaccugagcgccuaagccaggcucuggaguguggugcugguccagg

SEQ ID NO: 4191982 - RNA, 60 nt, Human
ccugcaagggcaacuuuguguggagaagcaggaccggagccacccagagcccuuugcagg

SEQ ID NO: 4191983 - RNA, 84 nt, Human
ccugcacccacuaccuuacuuuaacccugcaagcugguacuaucaugauccccauuuugcagaugaagaaagugguaggacagg

SEQ ID NO: 4191984 - RNA, 75 nt, Human
ccugcagcagccuucaguuuggcaggagauagauguggugaugggaacuucucugcagaauuugagcugcucagg

SEQ ID NO: 4191985 - RNA, 62 nt, Human
ccugcagcugcaaguccaggucagccacacuguucugguccuggccugaggucggcuguagg

SEQ ID NO: 4191986 - RNA, 58 nt, Human
ccugcagcuguccggagugaguaggcagggcugacacaugaccuccgcagcagcaugg

SEQ ID NO: 4191987 - RNA, 61 nt, Human
ccugcagggccacuguagaugaggagcuuccugucgcucagcaggacaauggcuuuagagg

SEQ ID NO: 4191988 - RNA, 91 nt, Human
ccugcaggucgcccacauaauugaaguaggaaguuuuagaggcagugagacauugauacaggcucuauuucauccugugggugcccucugg

SEQ ID NO: 4191989 - RNA, 69 nt, Human
ccugcauauaagaagugaagaagaguuaaaaugaaaauuuggcuguuucuuugauuucuuguuuguggg

SEQ ID NO: 4191990 - RNA, 55 nt, Human
ccugcauccgaaagugaucauaggcugccugugccuaggucauugauagugcagg

SEQ ID NO: 4191991 - RNA, 63 nt, Human
ccugcauuaaguugccuguaagacuucugacucugaauucuucccugggagcucaauagcagg

SEQ ID NO: 4191992 - RNA, 80 nt, Human
ccugcauuuguuuccucacagucaccuuuucuucuuuccuuuggucucugugaugauggaaacuuucuucaaaugucagg

SEQ ID NO: 4191993 - RNA, 109 nt, Human
ccugccaacaccuugauuucaaacuuugaguguccagaacuaagggaauccauuucuguuauacagucuguggcacuucauuauuggagcuuuaggguaacaggacagg

SEQ ID NO: 4191994 - RNA, 60 nt, Human
ccugccagagcuugguuuuuauuuagcauucuccccuaaaaagaaccaaagcucuguggg

SEQ ID NO: 4191995 - RNA, 63 nt, Human
ccugccagccagaucacucgccuguccaagaaagcacaaggcugggagguagaggaugguagg

SEQ ID NO: 4191996 - RNA, 125 nt, Human
ccugccaggagagucuccaugccuaucuucuuuccucugcugccauugccccaggggagaaugagggccuguggggccaguagagcaggccggaggaacugggggucaguagagcauccuggagg

SEQ ID NO: 4191997 - RNA, 114 nt, Human
ccugccaggguugggaaagcuucucacacucccagccucccacagucugggacuggauggcaaucacagcaucugcagagggagugcugggucagggagggcaggcuuggcagg

SEQ ID NO: 4191998 - RNA, 56 nt, Human
ccugccaugccuggugcagaaccuccaccuuagaaguggggacugggcggggcagg

SEQ ID NO: 4191999 - RNA, 81 nt, Human
ccugccauugccuuuuucuccaguccuuuaagcaucucuagaaucuggagguuuaugccuuggagcuggggcaauggcggg

SEQ ID NO: 4192000 - RNA, 67 nt, Human
ccugccauuuauaaccaguggccuuugggcaaaucuuucagcccugaugcuucucuguaaauguagg

SEQ ID NO: 4192001 - RNA, 68 nt, Human
cgaugugaaguuuuaguauauguagacauugugaauucauuuaguuaagcuaacuaaaauauccaucg

SEQ ID NO: 4192002 - RNA, 80 nt, Human
cgauguucggggcccauuaguuguuuguugugaagagacuuucugugcauuguaacaacuaaacauuucuccagacauug

SEQ ID NO: 4192003 - RNA, 124 nt, Human
cgcaaauugaaaguagaaucagggucaucucaguucuacuuuggaggaaaauugaggucauggucagauuaagcaaugacuuuuuaaauuuuuuucuaaaucaguggcuccugauucuuuugug

SEQ ID NO: 4192004 - RNA, 67 nt, Human
cgcacacucugggcuuugccaaguuaagcaaaauaggauaauugcaugcaaggcuccaaggggugug

SEQ ID NO: 4192005 - RNA, 58 nt, Human
cgcacccagcuuuugcauccuccgaguaucuggacuucuagggggacagcuggcugug

SEQ ID NO: 4192006 - RNA, 80 nt, Human
ccuacagggccuaauaacauuccucaaaguuuucaggaguugugaguuuuggaaugaugacaugaauguggcuuuguagg

SEQ ID NO: 4192007 - RNA, 82 nt, Human
ccuacaucccaagccagcuggaggagcagcuuccagucuucagagaugggccccucuucuucaguuggccuugguagucagg

SEQ ID NO: 4192008 - RNA, 104 nt, Human
ccuaccauacaggaaccucuuuccccaguucugggccagagaauagccuucaaaaccugccugggggcugcccuagagcuggcaaggggccuagcaugaguagg

SEQ ID NO: 4192009 - RNA, 64 nt, Human
ccuaccucuuuguaauaagaauugaggcaaauuugucaucaaaugcucuuugcagagagguagg

SEQ ID NO: 4192010 - RNA, 82 nt, Human
ccuaccuuuaauuuuaggaauauauuguaggagucucucaaacagaaaacauaauuugcauuauauuuauagaagaaggagg

SEQ ID NO: 4192011 - RNA, 67 nt, Human
ccuacuauaaaauacacaucugugaugaguaaaaucauuuuauagggaaggauauuuuaaugguagg

SEQ ID NO: 4192012 - RNA, 61 nt, Human
ccuacuccccuuuccuagcuucuguguggccauuucccagcagcuagaggaagggcagagg

SEQ ID NO: 4192013 - RNA, 85 nt, Human
ccuacucuaacuuacuugaaauggcuucuuggauuucuggguugagaagaauucugaggcuauguucaggcuaagugaaaaaugg

SEQ ID NO: 4192014 - RNA, 130 nt, Human
ccuacucuguaacccugcuuuucguuuccuguguguccuuucagagcuccuuuugcuuucaaaagcaaauacaaauacgggcagcuucugaauggauggccaagugacucuggagcuuccgcgcugugug

SEQ ID NO: 4192015 - RNA, 77 nt, Human
ccuacugcuucaugaaaaucacuggucaagcuucucacuuuuggaaauggcuuuuggauauuuuauugaaggguggg

SEQ ID NO: 4192016 - RNA, 72 nt, Human
ccuacuuagcagagugaguugacuaagugacugaaccuaucuaacccuuaguuucuucaccuguaaaauggg

SEQ ID NO: 4192017 - RNA, 60 nt, Human
ccuacuuccugggcaauguucugcuucccccaaacugaagcaggaggcccagagaggagg

SEQ ID NO: 4192018 - RNA, 89 nt, Human
ccuagaguagguucuguuauuacccuggaauauguuuguaauagagugggcuauuacaaucaucuaggauaaagauaaucguggcuugg

SEQ ID NO: 4192019 - RNA, 95 nt, Human
ccuagcccucaauaaguuuuauauuugaauugggacauauauauguaacgguuaugaccagagaguaggaggcauuauugagugguaaaaguagg

SEQ ID NO: 4192020 - RNA, 104 nt, Human
ccugugcugggcaggccugcaccgggaaguccugcacugggcagucccacaccgggcagucccgcauugggcauuccuggaacugcaggauuaccuggcacagg

SEQ ID NO: 4192021 - RNA, 116 nt, Human
ccuguggaaguuaggcaugaguucugcucugaggagccagugugucuguguugguagcuggcagucacuggugacuucugagcuggaugguaacguaauuagaaugacuucauagg

SEQ ID NO: 4192022 - RNA, 73 nt, Human
ccuguggauugcuguuucuaaaggccgucuguuccacauuaauagcccuugaaauagucuaaaaaaccagagg

SEQ ID NO: 4192023 - RNA, 59 nt, Human
ccuguggauuuguaagcaaagugaauuuuaaaaaauugcaugcuaacacagugcacagg

SEQ ID NO: 4192024 - RNA, 61 nt, Human
ccuguggccacacugcauacagacaguuccugacccucauggagcaggcagguggcccagg

SEQ ID NO: 4192025 - RNA, 65 nt, Human
ccuguggcucucuuuggaggucuggccaaacugacccaccagugcuccucaggaccagccacagg

SEQ ID NO: 4192026 - RNA, 73 nt, Human
ccuguggcuuccacgaccuaauccuaacuccugcgagucccuggaguuaggauuaggucguggaagccacagg

SEQ ID NO: 4192027 - RNA, 78 nt, Human
ccugugggaggcacaguguuuggucaguggggccuggauauucccaugacccugacccugugcuccuccccuggcagg

SEQ ID NO: 4192028 - RNA, 75 nt, Human
ccugugggugcuugaaugcaggccugagccuuaugugggaggagaggccaggaaucacugcugaguaaccacagg

SEQ ID NO: 4192029 - RNA, 79 nt, Human
ccuguggucauguaugugcuuguucuuugaaguuacaaaugaacaaugacuacauauugaugauaaguauaaauacagg

SEQ ID NO: 4192030 - RNA, 71 nt, Human
ccugugugaaagcccccucagcccagagugcuuggcagagcuggcuuugagcugggaggugucugcacugg

SEQ ID NO: 4192031 - RNA, 62 nt, Human
ccugugugaagguuaggcagguuuaggaugcuaguuaccucaugguucagcuuucacagagg

SEQ ID NO: 4192032 - RNA, 76 nt, Human
ccuguguggaaaguggucuaagcacaucugucucaucggauguaggcugcauuuggaacauguuuuccauacacgg

SEQ ID NO: 4192033 - RNA, 92 nt, Human
ccuguguucaccauguaagugggcagacaugauagaaggagaucuauuauacuuccuuguguuaugugccuauggaauagagggaacagugg

SEQ ID NO: 4192034 - RNA, 60 nt, Human
ccuguguuccccugcugcugaggacauuugugucacugcuguauuuagggggaacaaagg

SEQ ID NO: 4192035 - RNA, 74 nt, Human
ccuguuaugugccacacuugagggugauaugguuugaaagcaaguuucuuuccuuaggugcugggcagacaugg

SEQ ID NO: 4192036 - RNA, 56 nt, Human
ccuguucaauauucuuccuuguaacaauccucucaagugaagaaaccaggaauagg

SEQ ID NO: 4192037 - RNA, 96 nt, Human
ccuguugaaaggaacagaucagaguggauugugcugcaaacggagauguuaccugggggcagaugauuaauuuugauauugugugccuuaaacagg

SEQ ID NO: 4192038 - RNA, 94 nt, Human
ccuguugaaugaaaacacagguucauucugugaggugaauccaaacaucacaaagcauuuucacagauagcuuguuucuaguuuuuauugcagg

SEQ ID NO: 4192039 - RNA, 65 nt, Human
ccuguugagacaguuuccuuucagugauucuuucugcauaacuuuaagaggcagucuccaacagg

SEQ ID NO: 4192040 - RNA, 74 nt, Human
ccuguugaugagaaagaguuguaucuagaacauuuucuaacgaagcuucugacaauuucuuuguucucagcugg

SEQ ID NO: 4192041 - RNA, 81 nt, Human
ccuguuggaucuuuauguuccucuugagcuuuccaggaacacccagucaaagaaggaugaggaggaugaagugcuaaaagg

SEQ ID NO: 4192042 - RNA, 106 nt, Human
ccuguuggccugcacuggauggugucaugagcagcucuuccuccagauguacucagaggaucauugccaugucucaugcuacccuagugcuuagugauccaacagg

SEQ ID NO: 4192043 - RNA, 61 nt, Human
ccuguuuuagcugugguggaaggaguggcgauagauccuuccacaaugaaaauaaagcagg

SEQ ID NO: 4192044 - RNA, 58 nt, Human
ccuguuuugaaguuagaguccugugaaaaguuacuaucucuucuaacuucagaugagg

SEQ ID NO: 4192045 - RNA, 59 nt, Human
ccuguuuuuaguucuuuugaucguuuacuugauagacuguuaaauuccuuaagagcagg

SEQ ID NO: 4192046 - RNA, 101 nt, Human
ccuguuuuuuaucuuuuuugcauucaucauuugaaagcccaaagcaaaucuuagucuuggguuauaaaaguaaaaaauggaucaggagagauaauaucagg

SEQ ID NO: 4192047 - RNA, 95 nt, Human
ccuuaaaauguaaauguuaccaccggucauaauaaguuaugcaaaagcaccaguacagugccuggcauguuauagacacauuuauauuuuuaagg

SEQ ID NO: 4192048 - RNA, 83 nt, Human
ccuuaaacugcucuggagcucuuccuuucaggaggccagcuaauguugaccugucucugaaagagagcagccaggcaugaagg

SEQ ID NO: 4192049 - RNA, 77 nt, Human
ccuuaaauagugcuuggcccuaccagauacucaguaaguauuauuagaaucuagugucugguucaugcuuauuuugg

SEQ ID NO: 4192050 - RNA, 69 nt, Human
ccuuaaguucaaugaacucaguucucucuugaaaggaaaagcacagaacugaggcaauugccuuguagg

SEQ ID NO: 4192051 - RNA, 65 nt, Human
ccuuaauuucuguccuucagauagcugguacacagcacucuaauuuaaagggacagcaguuuagg

SEQ ID NO: 4192052 - RNA, 65 nt, Human
ccuuacaguuuaacacuuuggagaaaaaguucacauuuucuuuucuuuggaauugggcugcaagg

SEQ ID NO: 4192053 - RNA, 84 nt, Human
ccuuacuuacaugccaagauccucgucuuugagcgugagcccaaugucaaaauggaaugagacuuucuuuggcaagugaggagg

SEQ ID NO: 4192054 - RNA, 77 nt, Human
ccuuagaagguaaugaaacagcagcuaauuaacucugguaaagccuugauagguucugcuuuauuaucuuaauuagg

SEQ ID NO: 4192055 - RNA, 63 nt, Human
ccuuagcaaauuggcaucuucuggaacagcaagguuccuuccgagguguggauuuggcuaggg

SEQ ID NO: 4192056 - RNA, 58 nt, Human
ccuuagcugucaagguggcugcagugacaucccuauugugggugacuauacagcaagg

SEQ ID NO: 4192057 - RNA, 104 nt, Human
ccuuagcuuuguaguaaugcccugggauugccuuggccuugucuguaaucagaguuacacaaucaaggaaaaagcgagcucggggcugucauuucaaauggagg

SEQ ID NO: 4192058 - RNA, 75 nt, Human
ccuuaggagcuggaaggcauccagugagacacacuagaggagagauggucucugagguuguuuccagcacuaagg

SEQ ID NO: 4192059 - RNA, 58 nt, Human
ccuuagugugaggggauaccccaggccuuaacuggucucugaaaucccccaacugagg

SEQ ID NO: 4192060 - RNA, 70 nt, Human
ccuuauaauaacuuuaucaaauauauacuguuucuaccuuuaauguauagaugaggaagcuguuauaggg

SEQ ID NO: 4192061 - RNA, 105 nt, Human
ccuuauccccaaggagcuuaaaaucuggcaguuagcuauaaagugcaauaaaaguaaaaaacguaaauagugguucaaaauugcgcagguuuucccacaggaagg

SEQ ID NO: 4192062 - RNA, 96 nt, Human
ccuuauccucaaaugacagacagaagggauuuuuacaggcaaugaaagcugagaaauuuauaacuuuuuaauaucaguguguccuuagggaagagg

SEQ ID NO: 4192063 - RNA, 85 nt, Human
ccuuauuacauaacuuuaaaaugccguaauaccucuuuagaccacauuuuucucuaucagagauggugucagguugguaguaagg

SEQ ID NO: 4192064 - RNA, 58 nt, Human
ccuucaaaguacacaucuuuaucagcaucauaaaaaauagagaugguauuuugugagg

SEQ ID NO: 4192065 - RNA, 61 nt, Human
ccuucaaauuuagaacaagugacacugaugguaaauuuugcuaugcuucuaaguuugaagg

SEQ ID NO: 4192066 - RNA, 76 nt, Human
ccuucaacauuguagacuuuucauaugugguugucucugugacuuaaauguacaaucuaggguuugcauguuaagg

SEQ ID NO: 4192067 - RNA, 111 nt, Human
ccuucaaucuguacacguuaugugaugguuuauagaccuagaagucauccuguuucuuuaagggaaauuuucucucuaagacuuaaacgauaacauguaaaagaucaaagg

SEQ ID NO: 4192068 - RNA, 69 nt, Human
ccuucacaucuaacauugaauggcugauuaguguaaauuuauauuagugaccaagcaauuuggagaagg

SEQ ID NO: 4192069 - RNA, 81 nt, Human
ccuucacgauguucaguguuaguccauugcacucugggcuugaaacagcugcccaaaggcagugugauacugugguuaagg

SEQ ID NO: 4192070 - RNA, 69 nt, Human
ccuucagagucacauuuucuacuacuguacgguuaaacaucgucugugggaggaaaggugauguauggg

SEQ ID NO: 4192071 - RNA, 57 nt, Human
ccuucagcguccccuuuacccguuacucauagaauguagcggagccacgacuggagg

SEQ ID NO: 4192072 - RNA, 64 nt, Human
ccuucaggucauauaugucagaauuuauauauauauagagagagagaaauauauaacuugaagg

SEQ ID NO: 4192073 - RNA, 102 nt, Human
ccuucaguuuuuugaagcagcaugugucaaacuugugaugaaucagauuuuuauauucagaaucagaaucaguugacacagcugaugucaaugcuuugaggg

SEQ ID NO: 4192074 - RNA, 78 nt, Human
ccuucauauguaaagugcuuaaaaauucuagcauuaaacuaauaggguaguuuugaggauuauaugugacaaugaagg

SEQ ID NO: 4192075 - RNA, 69 nt, Human
ccuucaugaggccggcuuuauccaguacuuggauucuggaaucuggcaucuggcuuuuuauaaugaugg

SEQ ID NO: 4192076 - RNA, 83 nt, Human
ccuucaugccuggcugcucucuuucagagacaggucaacauuagcuggccuccugaaaggaagagcuccagagcaguuuaagg

SEQ ID NO: 4192077 - RNA, 55 nt, Human
ccuucauggagcuggaagcuguuauuccccccagcccacacaccagcucaggagg

SEQ ID NO: 4192078 - RNA, 91 nt, Human
ccuucauucauucauucauucagcaacuguuauuugaaggucuacuaugugccaguauuaggagugggaugaagaguagaguaagagaagg

SEQ ID NO: 4192079 - RNA, 69 nt, Human
cuaccuaguuuauuauacaaguguauguagaauagcgugcaaauauaugugugaugauuuacuaggaag

SEQ ID NO: 4192080 - RNA, 71 nt, Human
cuaccuauuauauuaacuucaggaggaacucagaaaauagggggcuuuagaauuugauauaaucaaggugg

SEQ ID NO: 4192081 - RNA, 70 nt, Human
cuaccuccagaggcccuaucccacuagauaauuuguagauucaauaggggaagggugcuuccugacuuag

SEQ ID NO: 4192082 - RNA, 94 nt, Human
cuaccucuucugcuucacggugaugcccuucugcuucagggcuuucucauuggccaucugcaggagcuggaucuccuugcgggagaagaggcgg

SEQ ID NO: 4192083 - RNA, 67 nt, Human
cuaccugauucccuuuccucugcauugcucauuggugugguugcagguggacacgggagacgggcag

SEQ ID NO: 4192084 - RNA, 69 nt, Human
cuaccugggaagggccaucuucuagauagcuuguucccaagcaguguucccagcuggccccucaggaag

SEQ ID NO: 4192085 - RNA, 67 nt, Human
cuaccuuaccuagaccaguuacaaugcagauaucuccuuucucuguaugaauauguuggggaggugg

SEQ ID NO: 4192086 - RNA, 56 nt, Human
cuaccuucaggcugcccuuugaucccuuuaagggaucaaaguccaucagaagguag

SEQ ID NO: 4192087 - RNA, 55 nt, Human
cuaccuuucacagcugugcagguuucucucagcuccaugccagaaugugagguag

SEQ ID NO: 4192088 - RNA, 57 nt, Human
cuaccuuuccuauaagguccagguauauaagcaccauggacauuauggagagaguag

SEQ ID NO: 4192089 - RNA, 84 nt, Human
cuacgguguuuccugaaguuauuucauccaagaggccauuuuuaggcaucucacaggauaaguggguuaaggagcacacuuuag

SEQ ID NO: 4192090 - RNA, 80 nt, Human
cuacuagaugaaugacaguguaugcuggugauuuugauuuuaaaaagucaaaaucaaagauacuugaaaacaucuggaag

SEQ ID NO: 4192091 - RNA, 55 nt, Human
cuacuaguggaagauuguuaacuuuuauccugguagacaguuaaacuacuggugg

SEQ ID NO: 4192092 - RNA, 58 nt, Human
cuacucugggcaccaaagagcagcuuuuaguagauaguugaguuggagccgggagcag

SEQ ID NO: 4192093 - RNA, 73 nt, Human
cuacugagucugugguauuuuaucauagcagcuugaacaacuaagacauauggugguaucaggauucuaagag

SEQ ID NO: 4192094 - RNA, 63 nt, Human
cuacugccagacacguuaugcucauuauuuaauuuucauaaugcaucugugcucugguagugg

SEQ ID NO: 4192095 - RNA, 58 nt, Human
cuacugcuaagggaaauguaaauugguuuguuugcuucuuuacacuccugggcagugg

SEQ ID NO: 4192096 - RNA, 107 nt, Human
cuacuggaguucacuuacuauguucaaggcagugggcuaggaaccuuaaaagauaugaagguuaaucgugaaucgcaugucuccucuggacacgugaauucuuguag

SEQ ID NO: 4192097 - RNA, 112 nt, Human
cuacuggguaggaaucaagcuguaugauuugguugcaggaaguaauugccugaaaagcaguuauguccucagcaaaucaagagcccuugaacauuucccaaugcuccagaag

SEQ ID NO: 4192098 - RNA, 77 nt, Human
cuacuggucaucugaucuacaaaugcgguggcaucgacaaaagaaccacugaaaaauuugagauggaggcuguugag

SEQ ID NO: 4192099 - RNA, 125 nt, Human
cuacuguaauauugaggaaauugagaaagguguucaaaguuuagugaaauaaauuuuuauugguuaaaaauaguaaaugaguaaagcggugucacagaaugccuuucugcaucagagcugcagug

SEQ ID NO: 4192100 - RNA, 56 nt, Human
cuacuguaguggccuauuuacccaucacgugacgaauuggauuaggucaccaguag

SEQ ID NO: 4192101 - RNA, 97 nt, Human
cuacuguccauccuaaaugauuuggcuuugacaagagggcaucuucagaucccuuuuggagauuaaauuuugucacaguuuugucauuucacaguag

SEQ ID NO: 4192102 - RNA, 85 nt, Human
cuacuuaguuaugacucagugaagaugugggaacugcugaaaucuugauuuaugguaguacucauguuuaagguuuuaauuguag

SEQ ID NO: 4192103 - RNA, 70 nt, Human
cuacuuauucagcagggacuuccuuucagccgagacucgcugaagaguccacuuaauugaguuuuaguag

SEQ ID NO: 4192104 - RNA, 83 nt, Human
cuacuuauucuacauuuggagugaugucuuuagccguggucacuauaccucugccuggaccucuucucgaguagaguaaccag

SEQ ID NO: 4192105 - RNA, 76 nt, Human
cuacuugcuuggaacugauuugucuauauucaaauaugaugauuucaucuuuguuuuggauauaaucagcagguag

SEQ ID NO: 4192106 - RNA, 101 nt, Human
cuacuuuggaagauuagauugugugcuacacgaggguaaggaauaucgcugacuaaucucuguauccucagcaucuagcaugaagucuaaguaccauguag

SEQ ID NO: 4192107 - RNA, 129 nt, Human
cuacuuuuuucuuuaggacuuugacacucuaggaauaugguuaugccuaugcuuuuugugucuaaugcacaauuagcagcauuaugauauaucuuaaguugauuguuuaauauucaaauaucuagguag

SEQ ID NO: 4192108 - RNA, 130 nt, Human
cuagaaacagggagcuucuauuuccugaagggcacagagguugccuccagaucagagaaaccuucugaccaauuguaguucuggaacuuucugaugcuuauccuauagggaauauaaacuuguuuuuaag

SEQ ID NO: 4192109 - RNA, 97 nt, Human
cuagaaagauaauuaugcaagcugcaguguucuggaaugcauuaucucuauucuaguuggaaaaguguuguucuaaacacuuuguaguucuuuguag

SEQ ID NO: 4192110 - RNA, 67 nt, Human
cuagaaauaaaucuucacuagcaacauuacaagaaggaauuccuucagugucccuaguagaaguuag

SEQ ID NO: 4192111 - RNA, 76 nt, Human
cuagaacagggaucggcaaacuauagccugcuggcaaaaucuagccugacagcuauuuuuguagauaaaguuuuag

SEQ ID NO: 4192112 - RNA, 81 nt, Human
cuagaacauguuauuuuggaaaauacaaacuauggaaaacccucauagguguuuguaauuuuguaaaauuauagguucaag

SEQ ID NO: 4192113 - RNA, 86 nt, Human
cuagaacggaauguauuguuuggaggaaaugaaagaugauuuaccaucauaaacuuguugcuuuuaauuaaucauugcucuuuugg

SEQ ID NO: 4192114 - RNA, 91 nt, Human
cuagaacucccuuuuaugucauauauacaugugugcaugcaugcauaugugugucuauguauacauguguauauaccaugcucuaaucuag

SEQ ID NO: 4192115 - RNA, 70 nt, Human
cuagaagagaggcuccuugagggcaggaaucuuucauucauuucuucacugaugucucucaaaugucuag

SEQ ID NO: 4192116 - RNA, 61 nt, Human
cuagaagcaugaaauggccauucucugagaugaaaauuuggagaggggcaaguuuaucuag

SEQ ID NO: 4192117 - RNA, 66 nt, Human
cuagaagcuucagggaagauaaaaagcauuauguuuauauccaucuuugaaguaaguaaaagcugg

SEQ ID NO: 4192118 - RNA, 80 nt, Human
cuagaaguagaguuuauaucaguuuguauuuauuacucauaauucaaauugugagaaauuucaacuguggauucuucuag

SEQ ID NO: 4192119 - RNA, 61 nt, Human
cuagacaucaaugaucagagguagcuauauaaaguccugcuuuucuuauugauguaacuag

SEQ ID NO: 4192120 - RNA, 65 nt, Human
cuagacuguaaauuacauaagaacaggaacaauguguuugcucacuaugaauuugcagugccuag

SEQ ID NO: 4192121 - RNA, 106 nt, Human
cuagagaaaugauucaguauucacuaauucaguguuugcggcaacuuuauaaaacauaacuacuguaaauaaugacaguugacuguacuuugagauuguuuccuag

SEQ ID NO: 4192122 - RNA, 88 nt, Human
cuagagaacacagaccauguggauccgagaguguuggaggggcagcucuagcuucucugggcuuuucggauccgaguucuguuccugg

SEQ ID NO: 4192123 - RNA, 59 nt, Human
cuagagacacuagagaagaagguuaacucaagagugaccaaagacuuuagauguucuag

SEQ ID NO: 4192124 - RNA, 61 nt, Human
cuagagaguggaaagcaagcugaguuggucacaucaaauucaauuguccuccaacuccugg

SEQ ID NO: 4192125 - RNA, 84 nt, Human
cuagaggagcaggagaacaaagcaagcugccccagaccacccggcuuucgcagaacccagaugaugcuccugucucccccuaag

SEQ ID NO: 4192126 - RNA, 68 nt, Human
cuagaggaugauccuuccuugccucuucccccuucuggugguuacuggcaaucauuggcauucucugg

SEQ ID NO: 4192127 - RNA, 64 nt, Human
cuagaggcuguuacacucccagaugccaacaaagcauugucagggguuguggaguuucccauag

SEQ ID NO: 4192128 - RNA, 65 nt, Human
cuagagggacaauaagauaaaaugguaggagacaaaguacuauccuuuuauacucuguccucugg

SEQ ID NO: 4192129 - RNA, 74 nt, Human
cuagauaagcuugcacuugccauuucaugcaacaggaagaacuuccccaucaaauggcaagugaaagcugguag

SEQ ID NO: 4192130 - RNA, 56 nt, Human
cuagaucagauugcuguuucuaacagugaacccauugggaagguaaguugguuugg

SEQ ID NO: 4192131 - RNA, 61 nt, Human
cuagauccuauugcuauuagugccauuauugagauaacuggaaaauucaaauggggucugg

SEQ ID NO: 4192132 - RNA, 74 nt, Human
cuagaucuuuuucugccaugugagaauacaacaagaaguuagcauucugcaucccagaagaggacacucacuag

SEQ ID NO: 4192133 - RNA, 74 nt, Human
cuagauggcugguguacuucagugauuccugugccuuuauguagacauagaaagucaugaauuacaccaucuag

SEQ ID NO: 4192134 - RNA, 57 nt, Human
cuagauuuuucaucuuccaggcucuccaaauccuggugagauuaacugagaaucuag

SEQ ID NO: 4192135 - RNA, 56 nt, Human
cuagcacuuagggauuguuaugggaauuugguuucagucaguuggccaugugcuag

SEQ ID NO: 4192136 - RNA, 98 nt, Human
cuagcagagggagagugagcuggagggugagccucaucucuuaagugcuuucacuuggaaaugacacacaucauuucugcucacuccccauuggcuag

SEQ ID NO: 4192137 - RNA, 79 nt, Human
cuagcagagggccuggcacagggaggcuauugugauggucauuucuccuagagccaccucugugcaggccucggguugg

SEQ ID NO: 4192138 - RNA, 78 nt, Human
cuagcagucgagagauggguuggcaggggcucagguuacuccaugucccugauaagagccaucgaucugggcuggugg

SEQ ID NO: 4192139 - RNA, 59 nt, Human
cuagcaucuccuuaggguaaggaaggcaaaaugcccauuccugaucccagauugcuugg

SEQ ID NO: 4192140 - RNA, 97 nt, Human
cuagccaggagggaggaagaccugcaugcggacuaacagaaaccauuuuggaagacaauguacaugcaguuuaaccucuuuaaagugaccuuguuag

SEQ ID NO: 4192141 - RNA, 79 nt, Human
cuagcgaaaugcuuggcacauaguaggucauuaaauauuuuucuaaugaagaagccaauucugugugagucauugcuag

SEQ ID NO: 4192142 - RNA, 127 nt, Human
cuagcuagcuagauaccuagcugucagguuggagcaaaaguaauugcgguuuuugcugcaauuaaagguuauggcaaaaaccacaauuacuuuugcaccaaccuaauagcuaucuaucuagggcuag

SEQ ID NO: 4192143 - RNA, 70 nt, Human
cuagcugagagguggcaagcuguaggcaucauucacacauucagaaaccguaccuugaaccuccaccugg

SEQ ID NO: 4192144 - RNA, 90 nt, Human
cuagcugccuuuccauuuuauaauuagggucuguccuuugacaagucuccaaauagaccugaaauauggaccuggcuuaaaggcagguag

SEQ ID NO: 4192145 - RNA, 67 nt, Human
cuagcugugcccgacccaugcggagcagcucaaagaaugcuuugcaagaagaauggcacaaagcugg

SEQ ID NO: 4192146 - RNA, 68 nt, Human
ccuccaggaccacagcacucugccucuuuccagugagggccuaagaggcagcccgcugaggcuggggg

SEQ ID NO: 4192147 - RNA, 75 nt, Human
ccuccaggagugugauucagagacagccugagacauaagcaaaauacucaacagucuaaauuauacccuuuuagg

SEQ ID NO: 4192148 - RNA, 60 nt, Human
ccuccagggaagagcugauguugcagccgucuggaggcagaauuccuucuuccuuggggg

SEQ ID NO: 4192149 - RNA, 108 nt, Human
ccuccagggagaagccaugaagguagcuugcuuccugaguaaacagaaauucuucuggaaaagugugcuuaggaaaggcaaggccuccauuuaaaaucuuccgacagg

SEQ ID NO: 4192150 - RNA, 68 nt, Human
ccuccaguuugguucuguucuccagccuucuucuggcuuggagcugucacucagaaccaaggugaagg

SEQ ID NO: 4192151 - RNA, 75 nt, Human
ccuccaucccugccacauggccacuguguucaugagccaauugggcaaugacaggaguggcuagugggagagagg

SEQ ID NO: 4192152 - RNA, 83 nt, Human
ccucuuggcugagcuucccucugcagucccugaugagcuaagcacccucucugggcagauggagaagcucugcacagucuagg

SEQ ID NO: 4192153 - RNA, 71 nt, Human
ccucuugguaauuauggauacuuaaauugcauuauagagagauguggaauugugcaugauuaacugguagg

SEQ ID NO: 4192154 - RNA, 76 nt, Human
ccucuugucugcagauacuuugaaagugguggaauugagcuaaaaauauucagaaguagcuaagcagucagacugg

SEQ ID NO: 4192155 - RNA, 77 nt, Human
ccucuuuaaaguuuucugccuucauuagauauuccaaacaggaaguuuuggaaugagggacggaggggaagaagagg

SEQ ID NO: 4192156 - RNA, 78 nt, Human
ccucuuuagggccuggccccagauuuccuguagaggaggcaacucauggagcggggaguggggcuuaccuugaagagg

SEQ ID NO: 4192157 - RNA, 63 nt, Human
ccucuuucucugucucucuggaagcacacaaaaaacgguuucucagaaaauguagagaaaagg

SEQ ID NO: 4192158 - RNA, 129 nt, Human
ccucuuuggccauggugggaagguaaugaggaaggcaggccagaggcuguuguugcguuggaaaucauuggacgacaagacucugacuuauuucucucaguaucugacuauuuccucuuuauugacagg

SEQ ID NO: 4192159 - RNA, 83 nt, Human
ccucuuuugccccaaguuguacagauuguauuagagaauagacuauuucugauguucauuucuuuuguacaacucaacagagg

SEQ ID NO: 4192160 - RNA, 63 nt, Human
ccucuuuuuaaccccccaauggcuguuaucaucccuucagaguaacugggugguagggagagg

SEQ ID NO: 4192161 - RNA, 97 nt, Human
ccugaaacuaaaaaugaauuuccagaucagaugacucaauuuuacuuugacucaauuccuguaaugcaucaucuuggcuggaguuccaguagacagg

SEQ ID NO: 4192162 - RNA, 85 nt, Human
ccugaaagcccauguccccuaccuucaaguuccucccucucccaagaagucguuagaaggaagaggaggcaguccuguggccagg

SEQ ID NO: 4192163 - RNA, 92 nt, Human
ccugaaauauaucacaguacuccccaaaguuucaagaauuguuugcaucaagugccuuuggaaugggagcuauuaguggaacauagaaaagg

SEQ ID NO: 4192164 - RNA, 61 nt, Human
ccugaaauccauaguuuacacugggguucacucuugguguuguacauucuauggguucggg

SEQ ID NO: 4192165 - RNA, 75 nt, Human
ccugaaauuauguuuucuccuuuucaucuguauuuuccuugucuucaagauacuaaaaggggaagcuccuucagg

SEQ ID NO: 4192166 - RNA, 78 nt, Human
ccugaacauccucuaccugcacaugccugacugcccgguaucccugcuccaguggcuguuccaggugaggaccgcagg

SEQ ID NO: 4192167 - RNA, 55 nt, Human
ccugaaccccaaaaccucugaaguggggcaagcccuacuuaaguaggggauuagg

SEQ ID NO: 4192168 - RNA, 81 nt, Human
ccugaacucugagcucuuauauugacaucaugcugcagaugguguacaugugucuaagaaugaaagauacagauuuucagg

SEQ ID NO: 4192169 - RNA, 59 nt, Human
ccugaagauggugaugggaucagagaagcuuaucacagauaccaaaaucaucuuauagg

SEQ ID NO: 4192170 - RNA, 77 nt, Human
ccugaagcaguaccuaugugguuucacugaagagaagcaugaccuuguucuuuagcagaccauguuggaaauucagg

SEQ ID NO: 4192171 - RNA, 56 nt, Human
ccugaagcugcauaccaaagacucacacagacucugcuaaauguguaggcuccagg

SEQ ID NO: 4192172 - RNA, 56 nt, Human
ccugaagucacuuuugaauaugucuccuggugcacauauucaagaguuucucuagg

SEQ ID NO: 4192173 - RNA, 84 nt, Human
ccugaagucuuuugaugaucucuggugguaaagacccuuguuucaaagucuuauuuaaagagaucauacuuccaagcacuuagg

SEQ ID NO: 4192174 - RNA, 57 nt, Human
ccugaauagacaucuggccauagacaaauccuccuugucuccagagacuucuacagg

SEQ ID NO: 4192175 - RNA, 58 nt, Human
ccugaauaggcucugcucaaaacaaacauggguuuuguacucugagcaccuauucagg

SEQ ID NO: 4192176 - RNA, 90 nt, Human
ccugacauguugcuagaaauaucaggauuauuaaaucuggauuaauauuuuggcuagauuuaacuuuuuggccuuuuagcaaagagcagg

SEQ ID NO: 4192177 - RNA, 83 nt, Human
ccugaccacacgcucacagggcccugugggccccacuccugguaccaagucccucgguuccccaggugcccggcgugcucagg

SEQ ID NO: 4192178 - RNA, 118 nt, Human
ccugacuccuggcaugcagggaaggguugugggcaggcaggggggcggcaaccacagugggcaaggacuacugcccuucuuccugcugcagccuccacccuuggcagccacucucagg

SEQ ID NO: 4192179 - RNA, 66 nt, Human
ccugacucugauuucgcugcauaacucccaggggcauccugcucugaugucaggaagggagucagg

SEQ ID NO: 4192180 - RNA, 74 nt, Human
ccugacuucaaacagggugcugggccaggccuggcagagaugccaucuggacaaaacucugaaggggaggaggg

SEQ ID NO: 4192181 - RNA, 74 nt, Human
ccugagacagugcuguuaauaaacacaaauugcaaacaagaagguaguaaguggaaauaaugcacucauuuagg

SEQ ID NO: 4192182 - RNA, 69 nt, Human
ccugagagauucugauuucauugggcugggugauacccaggcaguguuauuuuucagaaauucuccagg

SEQ ID NO: 4192183 - RNA, 55 nt, Human
ccugagagcuuuucuaaaagugauuagcaaacugauucuuggcuuagcucucugg

SEQ ID NO: 4192184 - RNA, 63 nt, Human
ccugagaggguggaucagccugauugggaagagcaccuaaacaggaaggagcaccugagcagg

SEQ ID NO: 4192185 - RNA, 70 nt, Human
ccugagagucugagagccuaaugaccuugauuuaaacaaugucaggcauuuaauucugcucagcuacagg

SEQ ID NO: 4192186 - RNA, 111 nt, Human
ccugagaucacaguucccauccucccccagagagugcccaagccuggcagggccaagauggggauggucuaggccaggacuggaguaggggcgggaugccugcuucuuggg

SEQ ID NO: 4192187 - RNA, 65 nt, Human
ccugagaucuuuagaagauagaaucagcaagacuugacaacugauuggaugugggaggucuuagg

SEQ ID NO: 4192188 - RNA, 83 nt, Human
ccugagcuaaccacugggcgggcagccugcugugggcuugucugugccccucagccuggccaggccugcccagggcggugugg

SEQ ID NO: 4192189 - RNA, 56 nt, Human
ccugagcuuuaaaagccauguaccaguuuguucuuuuaugguuuuugagcuugagg

SEQ ID NO: 4192190 - RNA, 56 nt, Human
ccugagcuuugauucaauggccacacaggauugggggaaagaaggcaaggcucagg

SEQ ID NO: 4192191 - RNA, 70 nt, Human
ccugaggcaucaguguuggcuucucagagccccaggugaguaaagcagaacagcugacauuguaagcagg

SEQ ID NO: 4192192 - RNA, 56 nt, Human
ccugaggcuccaccuccagagacuguaauucaagaagucugggguaggggcccagg

SEQ ID NO: 4192193 - RNA, 71 nt, Human
ccugaggcugugggguucugcuuucaacgagaacgacccuucggugagagagcaccccagcggcacgcagg

SEQ ID NO: 4192194 - RNA, 55 nt, Human
ccugagggcguaauuaacagugucuuuggagggacuguuugugcugucuucaugg

SEQ ID NO: 4192195 - RNA, 60 nt, Human
ccugagguaugagugugccagguguuuuuagggaagagcaagggcaccaguaugccuagg

SEQ ID NO: 4192196 - RNA, 57 nt, Human
ccugaggucgggaguucgagaccagccugaacaacauggagaaaccccgucuuuagg

SEQ ID NO: 4192197 - RNA, 76 nt, Human
ccugagucccggggaaaguccagggcagggaguauggguacuuguucuuccucuuuagggcuggccaggggccagg

SEQ ID NO: 4192198 - RNA, 57 nt, Human
ccugaguccugcugagcagagagggacuuucugagucuucucuccagguugcuuagg

SEQ ID NO: 4192199 - RNA, 57 nt, Human
ccugagugccugcugcaugccaagcacugggugcugccagagagacagggacucagg

SEQ ID NO: 4192200 - RNA, 60 nt, Human
ccugaguucuuugauagcugagaugucuuuaaauauuggugcaauagucaggagcucagg

SEQ ID NO: 4192201 - RNA, 88 nt, Human
ccugauaugagcaauuguugcuuguucuuucauuugucaugguggugcccugagugacagaaagaauaugucaaucccuccuguuagg

SEQ ID NO: 4192202 - RNA, 65 nt, Human
ccugauccuuuucugcagagccagaaaccauuucguucaagguggccaaaaggaagaagguuagg

SEQ ID NO: 4192203 - RNA, 78 nt, Human
ccugauggcaagagcugcaaauagcgugacaucaucaguaaccaauaaugcagucauuggugcagucucuuaccaggg

SEQ ID NO: 4192204 - RNA, 58 nt, Human
ccugauuguagcuaauaguaguuuaacagcuugaaauuggaaaaugcuacauaucagg

SEQ ID NO: 4192205 - RNA, 98 nt, Human
ccugcacacagcaucaguguucugucaagcugucacagugcaguuaaccacgcuggcucacaguacagugcuggcuccacugagucuaugucuucagg

SEQ ID NO: 4192206 - RNA, 65 nt, Human
ccugcagaccagauucuccguggcaccaccggggcucacaggagaaagucauggucccugccugg

SEQ ID NO: 4192207 - RNA, 72 nt, Human
ccuuucaacuuuuuacuaggaagcucaaauaguccuucaggcaaggcaguuuagugaaaagaaaaugagugg

SEQ ID NO: 4192208 - RNA, 78 nt, Human
ccuuucaggaugugccuguuaauuucagagaacuacacaucuauggcaccucuguagccauggguauauucugacagg

SEQ ID NO: 4192209 - RNA, 108 nt, Human
ccuuucaucuuugagucuuaaauuauuuuaaaagcauuaauucuugcaggauuccugcaaggcacauauuuuagagucacagauuuauagagacuugaagauaaaagg

SEQ ID NO: 4192210 - RNA, 57 nt, Human
ccuuuccccgcgggaggugccagcugauguggcagguguauccccgcguggggaagg

SEQ ID NO: 4192211 - RNA, 59 nt, Human
ccuuucccgcuuugagggcaaguuccugucucaaguuuuuguccuaacagugguaaagg

SEQ ID NO: 4192212 - RNA, 64 nt, Human
ccuuuccuuccauguugggcaaaaugacagguaguguacauauuugaucugaaggagggagagg

SEQ ID NO: 4192213 - RNA, 90 nt, Human
ccuuucgaugcucacuuguucuagaaaaaaacugcuguggaagucccuucaaagcaaugucuuuucugaaggacaauggagagcagaagg

SEQ ID NO: 4192214 - RNA, 78 nt, Human
ccuuucucccacucugucuuugucaggaccagaggauguuuggcauuuccccuggucaccaagacaagggagauaagg

SEQ ID NO: 4192215 - RNA, 63 nt, Human
ccuuucucucuuccaccaggcuuccauuguuugcaacaucuuuccuggcugguggaggaaagg

SEQ ID NO: 4192216 - RNA, 78 nt, Human
ccuuucugacuucaagaugaaucuuugggacgauguuucuggugcuugguccacagugauucacuuuugaaggagagg

SEQ ID NO: 4192217 - RNA, 115 nt, Human
ccuuucuguuggucucuuugguuuuaucugcuucauuaguugacaugaucauguacucauuuaacagauguuuauggagcauguacaauggaccaggggcaucaaaugcaaaagg

SEQ ID NO: 4192218 - RNA, 84 nt, Human
ccuuucuucuugucgucaugauucagaguagggauguaauguuuaaagaagaugguuuuggcucuggcauguggaaaagaaagg

SEQ ID NO: 4192219 - RNA, 62 nt, Human
ccuuugaagaaggacacauuugugaucggauaaauggaauggcuguguucauucaucagagg

SEQ ID NO: 4192220 - RNA, 64 nt, Human
ccuuugaaguuagauguggucacugacuugcuuaggccagcagugacauauaucucacuugagg

SEQ ID NO: 4192221 - RNA, 102 nt, Human
ccuuugaauuuaaggcaauaguauuaagaggugggcccuuuggaagugauuaagucacaagggcuccauccuuauaaaugggguuuaugcuuuuaucaaagg

SEQ ID NO: 4192222 - RNA, 80 nt, Human
ccuuugaggaucacuggauuaguuugaacuguugauggcuguuaaaucaguguggugacuugucugaugggccccagggg

SEQ ID NO: 4192223 - RNA, 79 nt, Human
ccuuugauccccaguggccucuguuggcuccuaggauggcaacuucccugggaacagcagaguccuggggcaucucugg

SEQ ID NO: 4192224 - RNA, 58 nt, Human
ccuuugcaaugaauuguuauugucccuuaauuuagcauggugcaguucacugcagugg

SEQ ID NO: 4192225 - RNA, 57 nt, Human
ccuuugcuauagaccgggugagagagaugaaucuugaacuaaggugguagcagcagg

SEQ ID NO: 4192226 - RNA, 85 nt, Human
ccuuugcugaccccaagagaagagaauuuauacuguaagacugacaguccuacagaacugagaauucucuaucaaugggcaaagg

SEQ ID NO: 4192227 - RNA, 69 nt, Human
cucccuguacuagaauuaugccuugcuguccacaaucaugugacuugcacacauauaauuuagguggag

SEQ ID NO: 4192228 - RNA, 122 nt, Human
cucccuguauccaauccgcucaacuuggugaccuacugauucuucaagaaacagcccaaauguuauuuucucugaagcuguuguagucuccugaaucuugagcaacauggaugcuuugggag

SEQ ID NO: 4192229 - RNA, 63 nt, Human
cuauguggagcagcaugaacaauccagacaccaaaaagggcaaggcaugucugcgccacaagg

SEQ ID NO: 4192230 - RNA, 56 nt, Human
cuaugugguagguguccuuagucuccccacuuuagagaugagaaacugacacaugg

SEQ ID NO: 4192231 - RNA, 103 nt, Human
cuaugugucaggaauugugcuaagcccugugaucaaauggcaugggagacaaacaaucccugcuuucacagagcucacaguuuagcagggaagaaagacaugg

SEQ ID NO: 4192232 - RNA, 61 nt, Human
cuauguucugcugaguuggaaugucaguuuuccuggaguuuaugcagcauguagaacaugg

SEQ ID NO: 4192233 - RNA, 71 nt, Human
cuauguuuugauguacagaauuguucacagguaugcuuauuugugaguacuuauguauauaacucacaaag

SEQ ID NO: 4192234 - RNA, 75 nt, Human
cuauuagguuggugcaaaauaauugcgguuuuugccaaagguaaaacugcaaucacuuuugcaccaaccuaauag

SEQ ID NO: 4192235 - RNA, 86 nt, Human
cuauuagguuggugcaaauguaauugugguuuuugacauuacuguuaauugcaaaaucugcaauuacguuugcaccaaccuaaugg

SEQ ID NO: 4192236 - RNA, 84 nt, Human
cuauuagguugugaaaagcaauugcaguucuugccaucacuuucaauggcaagaaccacaauuacuuuugcaccagccuaauag

SEQ ID NO: 4192237 - RNA, 92 nt, Human
cuauucagggauuuuacaaucauuagcaauuuucaauaaguacuggaugaugugucuuuuaucugacauuguuaguguauugccuggaguag

SEQ ID NO: 4192238 - RNA, 79 nt, Human
cuauucauacuauuauuugcaauaugucuuuauuauacaaaaugcugugauaaacauucuugcacaugugugugagugg

SEQ ID NO: 4192239 - RNA, 85 nt, Human
cuauucccauuuaaaaauaugcuauuuaugauuacaguugacuuaucccaaaggaguacaguggucauaauauaaaauggaauag

SEQ ID NO: 4192240 - RNA, 69 nt, Human
cuauuccccaucaucuauuauagugcagagaucacugcaggggcuuaaaagugggugaugaaggaauag

SEQ ID NO: 4192241 - RNA, 102 nt, Human
cuauucugccugcaccauagggcauggguugguggagauggagacguucugggugucaucugucuguucaacagccuggagccuccuugagcagcagaauag

SEQ ID NO: 4192242 - RNA, 60 nt, Human
cuauucugucagcaucaugguugucuuuauacaggcuaacaauagguuuuggcagaauag

SEQ ID NO: 4192243 - RNA, 68 nt, Human
cuauugaaaguguacaauucaauaguuuuuaggauauuuagaguucagaguugugcaacucucaguag

SEQ ID NO: 4192244 - RNA, 61 nt, Human
cuauugaggacauaaggacucugaagccaaguuaagguaacaauuccucauguuucaguag

SEQ ID NO: 4192245 - RNA, 70 nt, Human
cuauugcccagauauuagcaugcauaugaaucaccuggggcucuuguaaaugcagauucugauucaguag

SEQ ID NO: 4192246 - RNA, 101 nt, Human
cuauugcugaguuuaaaauuacccccaaaacuuagugacuuaaaacaacaaacaugcaugguuguugucacagguucugugggucaggaauuaagaagugg

SEQ ID NO: 4192247 - RNA, 95 nt, Human
cuauuggccagucaagcauuuauagccccuaucauccauuugcuacacaagacuucccuggauugguuauggagugacuuaacucugguuauugg

SEQ ID NO: 4192248 - RNA, 79 nt, Human
cuauuguaucuuaaagcugcuggugacugggcugaucuccugauuguuuagcgaauuaccagugcauuauucucauugg

SEQ ID NO: 4192249 - RNA, 74 nt, Human
cuauugucagugaguaaagguucauugaauuuuucuucugaugaauaaaauggucaguuuucucagugcaaugg

SEQ ID NO: 4192250 - RNA, 72 nt, Human
cuauuuaugugcuauuuuguauuuaucuggcucugaaguguggagucuaucaacaaaauagguacuggguag

SEQ ID NO: 4192251 - RNA, 76 nt, Human
cuauuuugcuuuauguaaauauguauguagguaaaugaggaaaagucuggaagcauguauacuaaaugcagaguag

SEQ ID NO: 4192252 - RNA, 56 nt, Human
cuauuuuuuuguccuuagggaacuaauauuguucuacaaggacacaacagagauag

SEQ ID NO: 4192253 - RNA, 86 nt, Human
cucaaaacacagaccuccucacucucagagaacaaggguacugcauggaaaggcaggcccagagggucaggagcugauguuaagag

SEQ ID NO: 4192254 - RNA, 60 nt, Human
cucaaagaagggagguauuugguuucaaauuaucaaaacagccuuguacucuucuuggag

SEQ ID NO: 4192255 - RNA, 89 nt, Human
cucaaagcgaaggccaagaucaccaagaaucuucacuuuuuacuucugugagacaggcuuccuucuugggauucuuggcugucuuuggg

SEQ ID NO: 4192256 - RNA, 76 nt, Human
cucaaagcgccugccucugugcuuaugcuccaugggcacccauguguccaggcuagaagucacaggccaggaagag

SEQ ID NO: 4192257 - RNA, 108 nt, Human
cucaaauccuccaaaaguuaccuugcuacacaguuucuccccggcaagcucaaccaagaauuugguggagcuggaagaauguagacguuggagcuggacagaucugag

SEQ ID NO: 4192258 - RNA, 58 nt, Human
cucaacacagccauuccccuagaaguuacagcacuucuagggucaccuguguucagag

SEQ ID NO: 4192259 - RNA, 88 nt, Human
cucaagaugucagcugggagcaaagccaugcauagaaggcaggucuucugugugugauuccugugcucuuuuagccauguugcuugag

SEQ ID NO: 4192260 - RNA, 79 nt, Human
cucaagcauauaugggcuuaauaaauaacaugucauuccaugaugauagggacagacauauuuggcccauagcuuagag

SEQ ID NO: 4192261 - RNA, 61 nt, Human
cucaaggcacuuuuccugagaugaugauuuaaauuuaucaugcucuccugggguccuugag

SEQ ID NO: 4192262 - RNA, 64 nt, Human
cucaaggucuuggcuccaaccaaaacgcuuugaaguacuugggccaggauuucaagacccugag

SEQ ID NO: 4192263 - RNA, 58 nt, Human
cucaagguugauauguguuuucaaggaacuaguucuugaaaaccauuugcaucaugag

SEQ ID NO: 4192264 - RNA, 80 nt, Human
cucaagugcccugggccuucagggccaggauacccccaucccucaccauggccccuggaggccauacagagccgccugag

SEQ ID NO: 4192265 - RNA, 68 nt, Human
cucaaguguguugacugaauuggggauuauacucacaacucuucccuagacagacaagaugcuaagag

SEQ ID NO: 4192266 - RNA, 57 nt, Human
cucaaguuucauauuugucuaggaagcccuucucgccucccaggcuugaaauaugag

SEQ ID NO: 4192267 - RNA, 125 nt, Human
cucaauauuccuuuaauauuagucucaaauuuggauuacugucuuuagggguagaaauauuuuuaaauuuaugauucuaccaugugagacagauuucagcuuuaagaagaaaucuggaaauuggg

SEQ ID NO: 4192268 - RNA, 67 nt, Human
cucaauccuaaagccauuaggugcagcagaagagggcagauaucuacaacggguggaguagggugag

SEQ ID NO: 4192269 - RNA, 80 nt, Human
cucaaugugugcagacugucaaaucugucucuaggagaacugauucacucuggacagacaaaaauaguaagcacauagag

SEQ ID NO: 4192270 - RNA, 69 nt, Human
cucaauuuucucaucuauaaaguggggauaauaacaccuaccucacagaaguguagugaggaaaaagag

SEQ ID NO: 4192271 - RNA, 65 nt, Human
cucacaaguuaguauugguuuugggaaguugcuuugcuuuugauguugauacuaccuucagugag

SEQ ID NO: 4192272 - RNA, 114 nt, Human
cucacagagcuuggggcaggggagaaguuaguguggaugcagggaggaggggcuccuucacugcuuagggguccauaccugagaugacgccucgccugaaucauccucugugag

SEQ ID NO: 4192273 - RNA, 64 nt, Human
cucacagcccucagcacaggucacgucccagcccagcucugggacuuugguucagggcucagag

SEQ ID NO: 4192274 - RNA, 67 nt, Human
cucacagggagcaagagauaaauaauccaggauucaagauuaaaaucgcuguugcuucuguggugag

SEQ ID NO: 4192275 - RNA, 84 nt, Human
cucaccacugagcuuggccaggaaugaauggggcagggcaaggacagucccauucagagcuaugggugcagcucccagggugag

SEQ ID NO: 4192276 - RNA, 57 nt, Human
cucacccccugacuuuauaucccgagguuuugaugugcccaggagugguggggugag

SEQ ID NO: 4192277 - RNA, 76 nt, Human
cucacccucagagccuccagaaggaaucaacccugccaacaccuagauuucggacgcugggcucuagaacugugag

SEQ ID NO: 4192278 - RNA, 65 nt, Human
cucaccugcaggcacaggugugcgcacuucgcaucucgaaggccggccagcaagcuucaggugag

SEQ ID NO: 4192279 - RNA, 76 nt, Human
cucaccuggagagcuugcuaauacacugguccccauccuaaucccccaagguaaaggcaaacucuccaaggauggg

SEQ ID NO: 4192280 - RNA, 71 nt, Human
cucaccugucuaucuggaauggaaccugcaggguucuaauacacuguuucuuuauucucagauacagggag

SEQ ID NO: 4192281 - RNA, 55 nt, Human
cucaccuuccccagaggggcuuaccagagccaggacccuguguugggagugugag

SEQ ID NO: 4192282 - RNA, 57 nt, Human
cucaccuugugauccacccgccuuggccucccaaagugccgggauuacaggcgugag

SEQ ID NO: 4192283 - RNA, 57 nt, Human
cucaccuugugauccacccgccuuggccucccaaagugcugggauuacaggugugag

SEQ ID NO: 4192284 - RNA, 59 nt, Human
cucacgaugcgcucaaacuccauggccugcuucaccuccuggggaaagccaucgaugag

SEQ ID NO: 4192285 - RNA, 130 nt, Human
cucacugaaguucccuuucugggacaguccuguguguucacauuugcugggacaaaagugaguguaagcagugaguagugaacagccacaggauuuuaaucaauccugugaagagggaaacuuuccauag

SEQ ID NO: 4192286 - RNA, 60 nt, Human
cucacugggagaugugggaaggggcgugggacgcacgcggucacucccucuccuagugag

SEQ ID NO: 4192287 - RNA, 60 nt, Human
cucacuuaugugccuugagcaggaagugccacaguggccuuauuauggcauguaaguggg

SEQ ID NO: 4192288 - RNA, 130 nt, Human
cucacuugccuucugggacaccuucuugauuagaagagaagggugugguguuacugucaugaugagcacugugcauauccacaccuuaucucugcccagggaugucagcaaucaaggagggacggauggg

SEQ ID NO: 4192289 - RNA, 78 nt, Human
cucagaagugagacccaagaggagccaacgucuguguuuugcacaagauacagaaugguuguuuguccacauuuuggg

SEQ ID NO: 4192290 - RNA, 60 nt, Human
cucagaaugcgcagaguggugugugcaugcagcaacguguauacacccugugcaucuggg

SEQ ID NO: 4192291 - RNA, 78 nt, Human
cucagaauuggcacuuggguccacguggauguaggucauuuuauuuccaagcugaauccaaugacagccugaucugag

SEQ ID NO: 4192292 - RNA, 68 nt, Human
cucagacuuagcucaagauuaauaugaaaacagggcccucccucaagucuucuuugaguucuucugag

SEQ ID NO: 4192293 - RNA, 72 nt, Human
cucagagagugaauuccugccucugccgcucguggcugugugaccucaggcaagcgacucacccucucugag

SEQ ID NO: 4192294 - RNA, 58 nt, Human
cucagagcagacuuugaaggagggggccauaguucucugggucauuuuuuccucuggg

SEQ ID NO: 4192295 - RNA, 82 nt, Human
cucagagcaggaagcuugacaaggaugaguaaagugguaucucagaaaaauacuuggucuuugucccuccuugaucacugag

SEQ ID NO: 4192296 - RNA, 65 nt, Human
cucagaggaggcagggugugcccugcccacgggcagugacucagcauacccugcuucuucucggg

SEQ ID NO: 4192297 - RNA, 76 nt, Human
cucagaggcccagcagcgcaggucuuggagaaugaaugugggucacugggccgcgcugcagagggccgguccugag

SEQ ID NO: 4192298 - RNA, 60 nt, Human
ccuggccaccucugcccuaccgagugggaccauucaccgggcaggagagggguggccugg

SEQ ID NO: 4192299 - RNA, 129 nt, Human
ccuggccagccagucuguuuuguguguacaacugagggggccucaggcccuuaaggagcugagaagccagguccagcaccuggaggcguccccaggaagugcaugacuacuggccacaugaauggcagg

SEQ ID NO: 4192300 - RNA, 69 nt, Human
ccuggcccugggguaggggcugugaggcugugggggcucgcuugcccacaugaccugaccuaggcuagg

SEQ ID NO: 4192301 - RNA, 56 nt, Human
ccuguggaauagaaucuucccucgccuugucuaggagaggugcugugucucacagg

SEQ ID NO: 4192302 - RNA, 111 nt, Human
ccuguggcccauuagacaagcugaggcugacaguuguaccugccccucuggagaccaucacuucuuagagggcggaagcugugucccagcuaucuuuauaugcaaagcagg

SEQ ID NO: 4192303 - RNA, 59 nt, Human
ccuguggccugaauuugguaaaauaguccacucauuuguuuacuucacagagccacagg

SEQ ID NO: 4192304 - RNA, 61 nt, Human
ccuguggcgggggccagugccuccccuccucugggcguggucuggucccugacccugcagg

SEQ ID NO: 4192305 - RNA, 61 nt, Human
ccugugggaaagcugguggugguguccuuuuccaccaucuuaguggccagcucucaccagg

SEQ ID NO: 4192306 - RNA, 60 nt, Human
ccugugggcuugaguguagggugucuucucuccuccaccguaaaugcaguuccccauagg

SEQ ID NO: 4192307 - RNA, 57 nt, Human
ccugugguuuuuagaggaaguauaauacagccauuagaaccacugaagacucacagg

SEQ ID NO: 4192308 - RNA, 70 nt, Human
ccuguguaucugggaaggggagaauagagcccuuuggcucuuuacuucaguauucucagauaaauucagg

SEQ ID NO: 4192309 - RNA, 55 nt, Human
ccuguguccuaauccaucaggcccuacccccaggaccucauggcgggggcauggg

SEQ ID NO: 4192310 - RNA, 76 nt, Human
ccugugugaggauuccugguucuucucugcccuuugaacuguguagcauggaagggauuaaagauuuucacagagg

SEQ ID NO: 4192311 - RNA, 90 nt, Human
ccuguguguaaagaguguuccaaacggauauaacagcaaacgcacaggccaugaccugggagcgugcuugucuuguuugagaaacauagg

SEQ ID NO: 4192312 - RNA, 73 nt, Human
ccugugugucuggaagcucagggagcagcugugaccugcacgugggauuccugagcucccaugaacaggcagg

SEQ ID NO: 4192313 - RNA, 55 nt, Human
ccugugugugauuguaugaguaugaauaccuugguauauaccaucccacaacagg

SEQ ID NO: 4192314 - RNA, 77 nt, Human
ccugugugugcgguggguucucucgcuagcgggggccgacuuucccuggccuggggccucagcugcuagcggacggg

SEQ ID NO: 4192315 - RNA, 121 nt, Human
ccuguuacuagagauuaguuugcauuuucuagauuuuauguaaguggaaugaugccaugugcauuuuuuugugucuggcauuuuucacucugcaugguuaucuugguguuuagccacgugg

SEQ ID NO: 4192316 - RNA, 71 nt, Human
ccuguuagaaggaggacuggcaguguugaucucauuaaucggcgccauaugugccagugucccuuccaagg

SEQ ID NO: 4192317 - RNA, 71 nt, Human
ccuguugaccuggcagcgcagcaugaagucggugaaauccucuuacugcuccguaugccaccuccuccagg

SEQ ID NO: 4192318 - RNA, 57 nt, Human
ccuguugcucugcaugaguuuagauuuauauuuagcucgaaaguccaggcaagcagg

SEQ ID NO: 4192319 - RNA, 61 nt, Human
ccuguuuacaucaucaaggacuuccuauuuugcuuaggguaaguccaaaauguguaauagg

SEQ ID NO: 4192320 - RNA, 71 nt, Human
ccuguuuagucucucaggagguuuuccugcccacgggggguauggcugccucccaggagaaucuggccagg

SEQ ID NO: 4192321 - RNA, 59 nt, Human
ccuguuuauccaugccaauccuugcacccucuucagaguuuuagcaugaaugcagcagg

SEQ ID NO: 4192322 - RNA, 63 nt, Human
ccuguuucagaauuuuuagugaguguuuuucucaugaauuuuuaguaaaauucuguaaagagg

SEQ ID NO: 4192323 - RNA, 69 nt, Human
ccuguuuguuccuucuacugcccucugagucaggacaauugaccagcagaguugaggaggacacgaggg

SEQ ID NO: 4192324 - RNA, 129 nt, Human
ccuuaaaaacuucugugcauuuguaucacgcugucugcucuucggggccacugcuuguguugcagggaagacacaaagcaugagaguuccgagcagugggcaaagaugcuugucaagaguguuauaagg

SEQ ID NO: 4192325 - RNA, 73 nt, Human
ccuuaaacaacuuguaguuuauuagagaaguuauguaugaguuaaacucuaguagauacaagaacguaauagg

SEQ ID NO: 4192326 - RNA, 70 nt, Human
ccuuaauaccaaagauuaaauagcaacaugaagccuccuucauuuucucuuuuucuguuggagauugagg

SEQ ID NO: 4192327 - RNA, 69 nt, Human
ccuuaauucuauuuaucuuucuuacuugaaauauguguuucugggguaugagauauaggugaauaaagg

SEQ ID NO: 4192328 - RNA, 61 nt, Human
ccuuacaaauauuugccuuuuaugucucugcaguagcugagauacuguggcgaaugcaagg

SEQ ID NO: 4192329 - RNA, 113 nt, Human
ccuuacauauuuuuaaaccacaguaucagcagagcuuaaaagagcauuuggcagauacuagauauccuaucuuaugaguauuguugaauaugugucaguuauucauagugagg

SEQ ID NO: 4192330 - RNA, 76 nt, Human
ccuuacaugacaauacuucaauaagcugaauuuguauuccucucauagacuuguaguuugaguauuguuacugagg

SEQ ID NO: 4192331 - RNA, 84 nt, Human
ccuuaccaaauauugcucuugccuuccucugcagugauugguucugaucacuguagagaaagcauggaagcucauuuuacaagg

SEQ ID NO: 4192332 - RNA, 62 nt, Human
ccuuacccagcccaugccuaccucagggaggacaauccuaguugggcagggguggggcaagg

SEQ ID NO: 4192333 - RNA, 68 nt, Human
ccuuaccccauccucgucugcacaucaaagggauuucuuguuggcuguggggcggggucggugccagg

SEQ ID NO: 4192334 - RNA, 110 nt, Human
ccuuacuuaagaguacagcuguacagaguaaauucacuaugcuuggaaacuucuuucauaucuauuuguguaagucugcagcuaguuucugaacaguuguauagugaugg

SEQ ID NO: 4192335 - RNA, 100 nt, Human
ccuuagacuaccuccugggccacuucugcucuguacugcacuggccaggccuaucuggcagggucugaggcacagggacagggugguguggggugucagg

SEQ ID NO: 4192336 - RNA, 64 nt, Human
ccuuagagaaugaaauuuacuacagaugaaauuuacuacauuuccugugguauauuuuauaggg

SEQ ID NO: 4192337 - RNA, 89 nt, Human
ccuuagauuuuugcugccuuugcccuugacacuguccuuucccuggagcugaaugucuggggguagaggaaugacuuuaaaagucgagg

SEQ ID NO: 4192338 - RNA, 58 nt, Human
ccuuagcauggcugugcuguguggauauaugcucucaugcccacagcaaaugcagagg

SEQ ID NO: 4192339 - RNA, 56 nt, Human
ccuuagcauuagaagcugugggcaaugcauccuaugccauuagcuuuguguugugg

SEQ ID NO: 4192340 - RNA, 84 nt, Human
ccuuagcgcuucaagauccauagauauugcuuugaauuuuagcucugcaaaauguaauaccuaugugaucuuagguaacuuagg

SEQ ID NO: 4192341 - RNA, 89 nt, Human
ccuuagucugguuuaaaauguguuuucacugaagauucucuagcaaacuaguagcauguuuaaagcagcauuugauaacaagaaaaagg

SEQ ID NO: 4192342 - RNA, 64 nt, Human
ccuuaucugcacacaauuuaucuuucucagggaugacgaaagaggacacuugguguaguaaagg

SEQ ID NO: 4192343 - RNA, 82 nt, Human
ccuuaucugucauggcuaccuuuagcacccauggaaucugcugggucauaugauuacgggccagggcugcucauacagcagg

SEQ ID NO: 4192344 - RNA, 129 nt, Human
ccuuaugaguguggaggaaugagggcucucaugaaaggaagagggcuacuccuaccucucucugccaugugaggauacaaggagauagcugucuaccaaucaguaagagagcccuuaccagacaucggg

SEQ ID NO: 4192345 - RNA, 88 nt, Human
ccuuauuaccucugcugaagucuuacaugucaucuaauagcuuuguuaugucaaaagagaucauaugaaaaauuucaaggacuuaagg

SEQ ID NO: 4192346 - RNA, 85 nt, Human
ccuuauugagggaauaaaggcaccauaaggcaaaacugcuguuuuaggcuuuauuguuuuugaacuuaggcuuccuucuaguugg

SEQ ID NO: 4192347 - RNA, 102 nt, Human
ccuuauuuuuuucugcaaguaauaccuggccuugauacaguaguacauuucugaccauugcuuaacuguauaaggcauagguaagcuguaggaaaacugagg

SEQ ID NO: 4192348 - RNA, 77 nt, Human
ccuucaaauauaaagucugaaagauaagagugauauaaucaaaugucaauuaugucuguagacucuguacuuguagg

SEQ ID NO: 4192349 - RNA, 117 nt, Human
ccuucaaccccccaccuuagauaagucacuggaucuuucugggcaucuguaaaaugggaauaguacagccagaggugguccugggucugggcuuuguggaggugggggcagagaggg

SEQ ID NO: 4192350 - RNA, 130 nt, Human
ccuucaaggucuaacuuccaagauucugugaguacgauucuagggagccucugccucagacuucuaaguaguucuucaggcugugcucuagaaguuacuggaaugaaagaaaaauuguaguguuugaagg

SEQ ID NO: 4192351 - RNA, 57 nt, Human
cucagaggcuuucaauguguuuuaugacauucauagagucaguuuugagcaucugag

SEQ ID NO: 4192352 - RNA, 67 nt, Human
cucagagguguaugagggugagaaggaugaagauggauuccuguacacggucuaugccucccaggag

SEQ ID NO: 4192353 - RNA, 60 nt, Human
cucagaucuucugcuguggggagcauaacugaucaaugacuccagcuguugagaucugag

SEQ ID NO: 4192354 - RNA, 60 nt, Human
cucagaugugagaaauauauugugauaaaacaaguuguccaaugcccuuuccacauggag

SEQ ID NO: 4192355 - RNA, 119 nt, Human
cucagaugugcaguccaauuuaagaaccaccaaggccuuaaagcucucuccagcauucaacuucaagcugcugggggacaacaaagagccauggaggaucuucuugacagcacccugag

SEQ ID NO: 4192356 - RNA, 71 nt, Human
cucagcaaaacagccguugccugggggaagaggugaguuuaauauccagguucuucguugcuuuuguggag

SEQ ID NO: 4192357 - RNA, 71 nt, Human
cucagcacucacuauaggacgcugcugcagggcccagcaagcagcccaguuguacugagugguuuugugag

SEQ ID NO: 4192358 - RNA, 56 nt, Human
cucagcagagcgagaccaagucaugccuuguauggaaauuucuuucuucuguugag

SEQ ID NO: 4192359 - RNA, 56 nt, Human
cucagccagugaucuuuccuuuggaccacaaccccucugaaaagcacugugcugag

SEQ ID NO: 4192360 - RNA, 57 nt, Human
cucagcccagcccaggaccaggauggaaguccuggaaacccccuggguggugcugag

SEQ ID NO: 4192361 - RNA, 71 nt, Human
cucagccucagcuuccugucugcagaaugggaauauuaauucugccucacaggcagcugggaggauuugag

SEQ ID NO: 4192362 - RNA, 73 nt, Human
cucagcgcgagaccuggcaggugggagaggcucgcucaugagagcuagaaaacagccugccuggguuucugag

SEQ ID NO: 4192363 - RNA, 114 nt, Human
cucagcuuacuuccugcucucagacuucauccuccacaugaccccccagcccagggugauggggcugggaggaauuuggggaauagagaccuggaaugggguaugagaccugag

SEQ ID NO: 4192364 - RNA, 58 nt, Human
cucagcuucuaccuccugagugaaaccucuucaucuuccucaccagguguaggcugag

SEQ ID NO: 4192365 - RNA, 84 nt, Human
cucagcuuuauacaugucaauuuaguacucuuaagcaucuguuuacuguuugauaaauauuuuuguuggcaugacaaaguugag

SEQ ID NO: 4192366 - RNA, 74 nt, Human
cucagcuuuguaaauuccacugguggaaacaagacuucacuuguugacccaaggcccuggaauugcaagcagag

SEQ ID NO: 4192367 - RNA, 55 nt, Human
cucaggagacaguguccacaugguuuucagaguccauaguggcauuauuccuaag

SEQ ID NO: 4192368 - RNA, 85 nt, Human
cucaggaggagcagagacucucaggaggugguagaggcccuggaacacugugguuucuuccacuugcuggcugcguuuuccuggg

SEQ ID NO: 4192369 - RNA, 57 nt, Human
cucaggaggaggaaguucauuggcugaccaggagccaauuagggucucucucuugag

SEQ ID NO: 4192370 - RNA, 57 nt, Human
cucaggauuaaggaaucuaaauuuaauuucauuuuggaugccuaaguaaguccuggg

SEQ ID NO: 4192371 - RNA, 83 nt, Human
cucaggcacagggcagaggccagccugccagaagcuuccccaucccuagcaucucugggcuccuucagcccuuuuagccggag

SEQ ID NO: 4192372 - RNA, 130 nt, Human
cucaggcagaaccaagcuugggccccuaguguagaagggcugucuucugggugccaggugcagcaaucacucuaggugucugcugcuaagcccagaacucgccuuuccagugacuaagcuucugcuugag

SEQ ID NO: 4192373 - RNA, 57 nt, Human
cucaggccaauaagcuccagcccccacccucaauggcagcuggaagaauggccugag

SEQ ID NO: 4192374 - RNA, 85 nt, Human
cucuuguauggaucacaauagacagcgcauuaaaaaugucaaaguacugaacaaaugugauuguuucugaaauuuaggucagggg

SEQ ID NO: 4192375 - RNA, 65 nt, Human
cucuugugcaggagugacaauaagaagugugcacugugaaaauugacauccugaguacauaagag

SEQ ID NO: 4192376 - RNA, 65 nt, Human
cucuuuaaauuuguguuuagagggucucauguuucuccaugaaacuuugcugcagguuuaaagag

SEQ ID NO: 4192377 - RNA, 65 nt, Human
cucuuuagcuuaauuaaauaaucaguccagccuagauggacugaugagaacuaggccuggaugag

SEQ ID NO: 4192378 - RNA, 66 nt, Human
cucuuuagugcaucuuauauuccacuguggguguguucauuauuaacaguggcuaagacugagggg

SEQ ID NO: 4192379 - RNA, 78 nt, Human
cucuuucagcagaaauauuaccaugcccucugcaguguacaaaccggaguaacauguguuaaucuuucugcaaagcag

SEQ ID NO: 4192380 - RNA, 56 nt, Human
cucuuuccccuacagagcacauuagacagauaugugagucucuguacaggaaagag

SEQ ID NO: 4192381 - RNA, 55 nt, Human
cucuuugccugcuacuuccgaagaaaucauauccaagaagaaguuggccaaagag

SEQ ID NO: 4192382 - RNA, 86 nt, Human
cucuuugguguggagggaaaacaguuaucucacauauggaagggaaaguucaucuuccuugguguaacugcuccuauggcaaagag

SEQ ID NO: 4192383 - RNA, 79 nt, Human
cucuuugguuucugucucuguaaaaaaaagugucuaauugcauuugggcaaaaaacuugcagugaagagagaaaaagag

SEQ ID NO: 4192384 - RNA, 65 nt, Human
cucuuuguagccuuugcauauucaacagaaugaaccugcccagggucuacaaaaauauuugagag

SEQ ID NO: 4192385 - RNA, 81 nt, Human
cucuuuguuucaacaaauucauaucgcaguuccugaauuuuaaaaagugcugugcaaaucgauuuguuggcugauaaaaag

SEQ ID NO: 4192386 - RNA, 73 nt, Human
cucuuuguuucucuaauucagaggaagaagauaaguaaagugucuaauucagaguuagacgaaaagcaaaggg

SEQ ID NO: 4192387 - RNA, 94 nt, Human
cucuuuuagagugaagaccuaaaauucccucagaugcauccaagaaaucaucuagucaagaguagggaugauaggucuaaguacaagagaagag

SEQ ID NO: 4192388 - RNA, 70 nt, Human
cucuuuuaugugacgugugugaccugguaucuagucacccugggguugcauacucucauucuaaaaggag

SEQ ID NO: 4192389 - RNA, 67 nt, Human
cucuuuugagggccagaggaagaggagagucaggauaccuuuuccuaggggcucuucauuugaagag

SEQ ID NO: 4192390 - RNA, 79 nt, Human
cucuuuugguucacacuaagcuuaagugguccacacgauugugugaauuuguacaaguauuaugugaacaacuagggag

SEQ ID NO: 4192391 - RNA, 85 nt, Human
cugaaaagugucuaaugagaauucuuuuuggguaccuauuaaaaauagugguuauuuagaacugaguuuuuauugugauuaucag

SEQ ID NO: 4192392 - RNA, 91 nt, Human
cugaaaaugugauaugagugcuagacuuuggcacagaacuuccauuguuugcaaucaguuguccaaaguucacaucacaucacagagccag

SEQ ID NO: 4192393 - RNA, 55 nt, Human
cugaaacaugguuagauucaagccaaagagugguuuggauguauuuauguuuuag

SEQ ID NO: 4192394 - RNA, 71 nt, Human
cugaaaccacagaauaacucuugcuugaguuauuacuaacucgauaacucuuguguuuuuuugugggacag

SEQ ID NO: 4192395 - RNA, 58 nt, Human
cugaaaccuggcuggccagguaugguuaaaguaaauaugccuuccagcuccuuuucag

SEQ ID NO: 4192396 - RNA, 89 nt, Human
cugaaacuacuaugggaauguacuuguuaauagaaagauuguuuuacuaaguccucucuuucugaaagacaauuugauacuaguugcag

SEQ ID NO: 4192397 - RNA, 66 nt, Human
cugaaaggcugacaugucaaugaaugaagaaaugggaguguuucauaaagcauuucagcuuuugag

SEQ ID NO: 4192398 - RNA, 93 nt, Human
cugaaagugugggcuucugagugcucugcuguuccagacaugugaucccuugagcagcugaucaaagcacuuauuuugagaccuuauacacag

SEQ ID NO: 4192399 - RNA, 59 nt, Human
cugaaauauuuagagaguaaguuugcaggaugucuauaacuuacugucaaguguuuuag

SEQ ID NO: 4192400 - RNA, 88 nt, Human
cugaaauccuggucucugugucugagagagcccuugggguucacccggacccauccugggcuguugucgggcacaagcaggaaaguag

SEQ ID NO: 4192401 - RNA, 73 nt, Human
cugaaaugacgguuuggggcaauguguggucucaucaccucggugcccaaagcuccagugaccaucguuuuag

SEQ ID NO: 4192402 - RNA, 91 nt, Human
cugaaaugggagccagugaugggaucagagguuguuaauuauacuaguaaucaacugagcccugguucucaaagccuguucccuggaucag

SEQ ID NO: 4192403 - RNA, 77 nt, Human
cugaaauucaccauccuuucuagaaauuagagauaaagcucuauaauggaaaguggaugugauuugugcuuuuguag

SEQ ID NO: 4192404 - RNA, 64 nt, Human
cugaacaaggcuggcugggaaaaacuuaauuuuaaguauuuuauuaccugcuaguuuuaaacag

SEQ ID NO: 4192405 - RNA, 71 nt, Human
cugaacauaggcauugcugguauuggaagugcucacuggggggcgucucuggguuaagcagugcaugucag

SEQ ID NO: 4192406 - RNA, 56 nt, Human
cugaaccacuaauauuuugauugacucaagugucaaucaaaguaguggcuggucag

SEQ ID NO: 4192407 - RNA, 67 nt, Human
cugaacccaggagguugaggcugcagugagucaugaucaugccacugcacuucagccugggugacag

SEQ ID NO: 4192408 - RNA, 89 nt, Human
cugaacccucaaugaguaaaggacuccauggguaagucauauuuuggguaacauauuaacacuuuggagucugcucaggggcuguuuag

SEQ ID NO: 4192409 - RNA, 81 nt, Human
cugaacgaacauuguuucugaccaugaugagcuuuuuauggauagucaaugcucacaauguuggagaaacagaucguucag

SEQ ID NO: 4192410 - RNA, 110 nt, Human
cugaacuaccaccagcuaugggaaugugagugauuuguaggcaaggccauuauuaaggucaccugcaaaguugcaucaaaacccaacaaguugguguuucagagguucag

SEQ ID NO: 4192411 - RNA, 71 nt, Human
cugaacuauauaaaacugccaauauuugugucuuuuuugaacuguaaugaaggcaguuuuauaagauucag

SEQ ID NO: 4192412 - RNA, 58 nt, Human
cugaagaagucucuaggcuauuaaguuaaaccuugaaugccauauuggauuucuucag

SEQ ID NO: 4192413 - RNA, 97 nt, Human
cugaagacaucugggagauaucaguuuauaaauuguauuuagagcaaugaaaucaucuagggagagaguguagauagagagguuuaggugucugagg

SEQ ID NO: 4192414 - RNA, 55 nt, Human
cugaagaggaugcugccaucaggcccagagcauuccugaagcagcaaacucucag

SEQ ID NO: 4192415 - RNA, 55 nt, Human
cugaagauagugucugaucaugacuuugcaaaguaacagacgaagugaucuucag

SEQ ID NO: 4192416 - RNA, 74 nt, Human
cugaagcaauagagacaagaccagaacuaguuuuccugacucucagacuggucuuguacuauguugcauuacag

SEQ ID NO: 4192417 - RNA, 65 nt, Human
cugaagccaguuugcugcccuuggggaggagauaaaaucugaguggcaaaauaacugagcuccag

SEQ ID NO: 4192418 - RNA, 66 nt, Human
cugaaggagcucaggagauagucaccaguagcauggaggcugagaucugucucagagcucuucuag

SEQ ID NO: 4192419 - RNA, 59 nt, Human
cugaaggcuggggugcagacggccuccucagugaugaaggcaaauggcccaggccucgg

SEQ ID NO: 4192420 - RNA, 80 nt, Human
cugaagggagaggggucuugagucaaguaacuaagacuuuauguccugcuaagucacucaagaccucuccacucccucag

SEQ ID NO: 4192421 - RNA, 56 nt, Human
cugaagggcaaggaaaggacaauaaagucugucuuucuacaucauuugcuucucag

SEQ ID NO: 4192422 - RNA, 58 nt, Human
cugaaggggguuucacugagcugcagccaaagcaugggugagacugugcucccuccag

SEQ ID NO: 4192423 - RNA, 118 nt, Human
cugaaguauagugcagggugucaggcacuguggcggcuuccauguugcugcuggucaguugguucaccugcuuagcauggggcagcuccuggaaaagcaccuggaucuccuucuucag

SEQ ID NO: 4192424 - RNA, 61 nt, Human
cugaagugccagacauuuguuaaaauuagagguaguaaaauaacacauuuugguacuuugg

SEQ ID NO: 4192425 - RNA, 64 nt, Human
cugaaguuaaaguaguuuuuauguaguuaaagguuugaacaguaaaagaacucuucagcuucgg

SEQ ID NO: 4192426 - RNA, 93 nt, Human
cugaaguuucugcuaaucagggccaggacuaggaugaggugagagaggugacucagugucuucaccugaguccuggcccugcugcuacaucag

SEQ ID NO: 4192427 - RNA, 98 nt, Human
cugaauacuugugucuccugaaaauccuuauguugaagaccuaaccuccaaugcaaugguguuaggauguggggacuuugggagagaauuagguuuag

SEQ ID NO: 4192428 - RNA, 61 nt, Human
cugaauagcugaauaaugcgucugcagcuuuuuacgucacugcgcgugcaacagcuguuag

SEQ ID NO: 4192429 - RNA, 60 nt, Human
cugaauauuagucaugucugaucucccuucccugguuauuagaggucuggcugaauucag

SEQ ID NO: 4192430 - RNA, 69 nt, Human
cugaaucauauaucuaccugcaauugcaaaggaaugggcuugguguauuguaagugguuauaugcccag

SEQ ID NO: 4192431 - RNA, 96 nt, Human
cugaauccagcuggcaggugaggcaugugccuggagaacuguaagaacauuggggcuucaugccucacuuuacaaggcagcaaauggaggccacag

SEQ ID NO: 4192432 - RNA, 55 nt, Human
cugaaugaacuaaaucauaguucugcugaauagaacugaaaauaguucaguucag

SEQ ID NO: 4192433 - RNA, 70 nt, Human
cugaaugaucuccgauuaguccuuuaacaauucagauccuaaaucuaaaggcuaaaagagaaucauuuag

SEQ ID NO: 4192434 - RNA, 63 nt, Human
cugaauggcuacuucagaggacaaauccuuaaggaggugaugagucacugcaggugcuggcag

SEQ ID NO: 4192435 - RNA, 83 nt, Human
cugaauguguccaggcccugcuuagcacccuugcaccagacccuguaguacgguggguauaguuagggccucugacacuccag

SEQ ID NO: 4192436 - RNA, 106 nt, Human
cugaauguuugugaagguguugacccauggauacuaagguaugugaaaauaacucacacaucucagguguuuaaugaggaucaauaacaauuugugggcccaucag

SEQ ID NO: 4192437 - RNA, 67 nt, Human
cugaauuugccuuauuucauguaaaauuuaugucauucaguuuuugacaaugaguuugaggcaucag

SEQ ID NO: 4192438 - RNA, 59 nt, Human
cugaauuuuaggguaacagauguuugcuuauuauaggaagacaaugcuguaaaauucag

SEQ ID NO: 4192439 - RNA, 65 nt, Human
cugacaaacagggaguuugcucaccuggccaagacccccggugaggcagaaauuccuguuuucag

SEQ ID NO: 4192440 - RNA, 79 nt, Human
cugacaacaguggggagucugcacaauugaucauggcaaaauguuuuucuccugauaucugcagaccuacacugugcag

SEQ ID NO: 4192441 - RNA, 102 nt, Human
cgaauuaaggugucagcagaccugugcuucucuggaaggcucuacgggagagauuuaccuucuccagcuuccaguggcuggcugcccacacaccuuggcucg

SEQ ID NO: 4192442 - RNA, 74 nt, Human
cgacucccggcaugcagugcuuugcgccgggcacgcucugcgccugcgugcugcgcgcugcccgcuggggcucg

SEQ ID NO: 4192443 - RNA, 62 nt, Human
cgagacugagaucugaaugguguuuguggguucccgaggccuggcaggaaucucagugcuug

SEQ ID NO: 4192444 - RNA, 130 nt, Human
cgagagcaaggcuagggaagucggcguugccguuuucucucuguuugcucugccuguucccgcuuccuuggaacauuagauaacucagaaaggaaagacccgucucucguuucuggcccuuguccucucg

SEQ ID NO: 4192445 - RNA, 84 nt, Human
cgagagguaugcagcagucgcugaugcgcccccugagggcuuucucacccucagggacagggugcugcugcguaaggaaucuug

SEQ ID NO: 4192446 - RNA, 57 nt, Human
cgagauuuccaggacgggaggugggaucugaacccuccacggucccccuggaguccg

SEQ ID NO: 4192447 - RNA, 60 nt, Human
cgagcuaacuguauucuguaggcagauacuagagaauuucuccugagugcaguuggcuug

SEQ ID NO: 4192448 - RNA, 59 nt, Human
cgagcuggccuccgggugccugggauguuucucgcagaacaaaaggaagccaugucucg

SEQ ID NO: 4192449 - RNA, 58 nt, Human
cugacucugaguggugucaccaaaaccauggaucaagggggcaucaagacagaguuag

SEQ ID NO: 4192450 - RNA, 56 nt, Human
cugacugcuccacaccguccauacuccuccagaggagcucggggcggagccgucag

SEQ ID NO: 4192451 - RNA, 85 nt, Human
cugacuggcccagaugagugugggcucagcuauagugccuguaaagcaggauuaucguaucucuuggucuucauucagccuuuag

SEQ ID NO: 4192452 - RNA, 87 nt, Human
cugacuguuagagggaaaaaucauuugccacaggugaaugacaaauaacuugugacucgcuuugugguuucucucuuugagagauag

SEQ ID NO: 4192453 - RNA, 72 nt, Human
cugacuuagaugccaucuuuuauucuucuagaaacugagaaauucugcaagauuggaagaugcaauauucag

SEQ ID NO: 4192454 - RNA, 130 nt, Human
cugacuucaagccucccauucccaggaugagauggacaaauagcaugacacuuguauuccaagcacaaucuugaggcaaccauguuuuuguccauggccuugcccuguaauugugggauguauacgcgug

SEQ ID NO: 4192455 - RNA, 81 nt, Human
cugacuucgaugcuacugaccuugugagcuggccccaucuucucucugggccacuguuuccugggcaguuugcauucucag

SEQ ID NO: 4192456 - RNA, 56 nt, Human
cugacuucuugcucauacuagcuguucuauucagaucagcuagugguaggagucgg

SEQ ID NO: 4192457 - RNA, 98 nt, Human
cugacuuugcccaagcuguagguuauucuguuccagugguucucagcccuagcugcacaucaggaucacagaaacuuuuauagcuucuccggaaucag

SEQ ID NO: 4192458 - RNA, 64 nt, Human
cugagaaaagacauuucuagaugauauagccagugaauuuaggaauuuaugucuuaguuuucgg

SEQ ID NO: 4192459 - RNA, 58 nt, Human
cugagaaacaaugaauugugaucuugcagugggagaugcaaagauuauuugugcucag

SEQ ID NO: 4192460 - RNA, 65 nt, Human
cugagaaaccaggugcucugauuugcaacucuagacagggagaacuuagagcucugguucuacag

SEQ ID NO: 4192461 - RNA, 120 nt, Human
cugagaaaccucgcugagaaagcugaucagagagaaggucccaagaggcuggaagauccucucaucucaggcugacauugggacuccccuuggauuaucuuuguaucaggagggccucag

SEQ ID NO: 4192462 - RNA, 78 nt, Human
cugagaaaggaauucaaagcuacugacuuuagcuacuuauuaccucaagucugcaggcugugauuuuuuaaauuucag

SEQ ID NO: 4192463 - RNA, 67 nt, Human
cugagaacccauuagcagcagagauacuuucacaaguuagguguuugcuggagcucugggucauaag

SEQ ID NO: 4192464 - RNA, 71 nt, Human
cugagaagagguugucugugaugaguucgcuuuuauuaaugacgaauauaacacagauggccuguuuucag

SEQ ID NO: 4192465 - RNA, 67 nt, Human
cugagaagucagagaucaaggugucuacagcaauggugucuggugagcgcugcucucugcuuccaag

SEQ ID NO: 4192466 - RNA, 63 nt, Human
cugagaaucauggcaacagaaugaacuuguaucacaucaaugucauuacagucaugauuccag

SEQ ID NO: 4192467 - RNA, 68 nt, Human
cugagaauggacagcagggcaggaagcauuguccccaaugcccauaagccuuuguuuucuuuucuuag

SEQ ID NO: 4192468 - RNA, 86 nt, Human
cugagaauggggagcauguggggugagcagggggacugcccagagaucugcagcugcugcuccuccucacugcuccacacacucag

SEQ ID NO: 4192469 - RNA, 58 nt, Human
cugagacaugguuugacuggcauauaucuuuauucccauagcggacucaugucaucag

SEQ ID NO: 4192470 - RNA, 87 nt, Human
cugagaccucugacgccuucauuuccugcguuggccaccaggcacagaugcuguguccaucugacaggagaggaagcggggucccag

SEQ ID NO: 4192471 - RNA, 71 nt, Human
cugagacuuucaugugcuuuuauauauccuugaaaaaaccccauaggagaauuagcauauggacuuuucag

SEQ ID NO: 4192472 - RNA, 62 nt, Human
cugagagcccugcauggcugaugaaguucaguucucucauugucgcucugcgguguucucag

SEQ ID NO: 4192473 - RNA, 90 nt, Human
cugagagcgcccaauucugcaccccagacugagucaugaccuccugccaggcugacucugacuggagugagagaggggcagugcccuggg

SEQ ID NO: 4192474 - RNA, 60 nt, Human
cugagagcuggcugggaucucugggaaggaacauggccccaggccccaggaaacucucag

SEQ ID NO: 4192475 - RNA, 72 nt, Human
cugagaggaauugguucaagguuuaucuggagcuuuaaagucuaaaccucaaaucagugucaauuaccucag

SEQ ID NO: 4192476 - RNA, 59 nt, Human
cugagaguaguacugagaacugcgguagccaucaugccgcaacuuaucgcauucugcag

SEQ ID NO: 4192477 - RNA, 82 nt, Human
cugagagugaggguuguguggacugauuccaguucuugauguagucacauaaaggcacggaguuguuauggaaacccuccag

SEQ ID NO: 4192478 - RNA, 55 nt, Human
cugagauggagccacugcacucuagcgugggugauagagugagacuccaucucag

SEQ ID NO: 4192479 - RNA, 56 nt, Human
cugagauggaguuucgcucuucuugcccaggcuggaaugcaguggcaccaucucag

SEQ ID NO: 4192480 - RNA, 56 nt, Human
cugagauggaguuuugcucuugucgccuaggcuggagugcaauggcaccaucucag

SEQ ID NO: 4192481 - RNA, 56 nt, Human
cugagauucugugaaacggacauuuguuaaagcaagugucaauucucaaaucucgg

SEQ ID NO: 4192482 - RNA, 59 nt, Human
cugagcaacacauugaaugaggauucuguucguaauucuuauaaaaaguguugacuugg

SEQ ID NO: 4192483 - RNA, 73 nt, Human
cugagcaaguacugaggaguaagccaagauuuucccuaaaaauaauuuuaaguuuauuccaguacaugaacag

SEQ ID NO: 4192484 - RNA, 124 nt, Human
cugagcacagggccaucccaggagcuaaucacgccugggaguccacaccugcuaguuucaaaaggaaauuguauagagccagcugugggcucaggcggacgcugaagggaguggccaggcacag

SEQ ID NO: 4192485 - RNA, 75 nt, Human
cugagcacuugaaauguggcuaguccaauuaaugaauuguccaggaucaguuuuuaaagccacacagggcuacgg

SEQ ID NO: 4192486 - RNA, 55 nt, Human
cugagcagcucccugagugguccugacuuccaaaacagcuuucuggucugcucag

SEQ ID NO: 4192487 - RNA, 57 nt, Human
cugagcaggauauucacagcagacgcugcucucucugugugugacaaccuaguucag

SEQ ID NO: 4192488 - RNA, 79 nt, Human
cugagcauaugggauuagcagcauguaagugaguagaaguaguucuuauguucucuugcaguuguccuauuuuuuucag

SEQ ID NO: 4192489 - RNA, 79 nt, Human
cugagcaugagauuuuuggacacuuuuacauguucguauuugggaauaacuaaaguaaccaaggauaucacugggccag

SEQ ID NO: 4192490 - RNA, 117 nt, Human
cugagcccagcacuggcggggcugggguggaaggagcguggaaucgggugcgagaggacagucuccuucagauuccugcuucuggcagccuggggaccaguuggggcacgggcuggg

SEQ ID NO: 4192491 - RNA, 64 nt, Human
cugagcccaggcagagguugcagugagacgagauuucaccacugcacuucagccugggugucag

SEQ ID NO: 4192492 - RNA, 76 nt, Human
cugagccucaguguucuuaucuguaaaaugggaauaauuacagcaagucccccggcagggugauagugaggcucag

SEQ ID NO: 4192493 - RNA, 64 nt, Human
cugagccuguucugguuggcugacccccugggaaauccagggaguuuccaaucugagagcuugg

SEQ ID NO: 4192494 - RNA, 66 nt, Human
cugagcgagagaagcacaugaugccacuggaaauugauaaaaucuuguauaacuucucucccucag

SEQ ID NO: 4192495 - RNA, 71 nt, Human
cugagcgcaagggcugacuacgcuguauuucacaaccgagcccuagcgccagcucagcacccuacgcucag

SEQ ID NO: 4192496 - RNA, 73 nt, Human
cugagcugaucuccacacagggucgccugcggcgugcaccagcuggccacacugcugauggagcuggauucag

SEQ ID NO: 4192497 - RNA, 86 nt, Human
cucugcagcucacacucccgcaggagcagcucgcagcuccggaagcugucccugagcaacuccuguuuggaggcugagagcaagag

SEQ ID NO: 4192498 - RNA, 58 nt, Human
cucugcccagugcccacaggagcagggcuggccaguccccugaggcccugggccagag

SEQ ID NO: 4192499 - RNA, 79 nt, Human
cucugccccaaggaggguggccucaugugagugcucagguugcguagugaacaaggaugccaccucuagggggucauag

SEQ ID NO: 4192500 - RNA, 55 nt, Human
cucugcccccagcuggugcuuggcucccagucuuaggcugaguuagggggaggag

SEQ ID NO: 4192501 - RNA, 61 nt, Human
cucugccgugcuagauuuggcuuaggggauugagaguagagauggcagggcccuagcagag

SEQ ID NO: 4192502 - RNA, 85 nt, Human
cucugccuacucagucacagcccaucuacaguuggcuuggucuuuagugacaaggcugcugugauugggaacuuguauggcaggg

SEQ ID NO: 4192503 - RNA, 102 nt, Human
cucugccucagucugcacccuauccccagauugagcacuugaaccccucugugacuucaucuugccacuggggcuaggacuguuccugacuugaggccagag

SEQ ID NO: 4192504 - RNA, 130 nt, Human
cucugccuccagcuucagcugcuccuggcccagaauguacagcugcugcugaagguuguugauguagcucucgagcauguuguccauguugcucugugccgucuucugcugcuacuggaggcuacacuug

SEQ ID NO: 4192505 - RNA, 82 nt, Human
cucugcuccacugucccaugggacuugauuuacaaaauacaaagaugaaauuguuuaaaaguucaaggugauaguggcagag

SEQ ID NO: 4192506 - RNA, 76 nt, Human
cucugcuccugcuucauuaaugucuauaaguuuguuacaaagacagaaacugacaggaaaugaauuuaggguaggg

SEQ ID NO: 4192507 - RNA, 63 nt, Human
cucugcugccugauugcagaccucggguuucgagucccagagguguugugagaggcagugaag

SEQ ID NO: 4192508 - RNA, 75 nt, Human
cucugcuggguugaugguguauagaaaaugcaaacauuacuuauuuuuuacagaaucauuaaucauggugcaggg

SEQ ID NO: 4192509 - RNA, 58 nt, Human
cucugcuggugaccacugggccucacuguccccuaaguaacgcccauugccaguaggg

SEQ ID NO: 4192510 - RNA, 84 nt, Human
cucugcuguggccuauggcuuuucauuccuaugugauugcugucccaaacucauguagggcuaaaagccaugggcuacagugag

SEQ ID NO: 4192511 - RNA, 57 nt, Human
cucugcuguuagugugagguuugaggauuuuacuuuaaccacauggauuagucagag

SEQ ID NO: 4192512 - RNA, 72 nt, Human
cucugcuuagccgcgaccucgccucggcgucacugcgcaugugcgccagaggaacgcugcgcgcccgcagag

SEQ ID NO: 4192513 - RNA, 56 nt, Human
cucugcuucugagauggaagcuaacuaaggcagaccccauacucaagagguaagag

SEQ ID NO: 4192514 - RNA, 65 nt, Human
cucuggaagacccuaagcagugggccaccaaggggcuggccaagccacugcugggucugcaggag

SEQ ID NO: 4192515 - RNA, 93 nt, Human
cucuggaccaaaauuucucaaguuccuuagccuuagggcuucccaugcuggagccucagguguaggggaugugacaaaggacaugcuccagag

SEQ ID NO: 4192516 - RNA, 93 nt, Human
cucuggaggcagccaucauaagagcaaguggguagugaagcucucacaccgggcugguucucugaucacugccucccuggcugucuccaagag

SEQ ID NO: 4192517 - RNA, 73 nt, Human
cucuggcccugcuggagagccuuggccaaggcccuuccaucucugggucugccucuuccucccagggccaggg

SEQ ID NO: 4192518 - RNA, 83 nt, Human
cucuggccuagaaaugaauuaacuaaaauucacuuuaugccgaaaggauaaagguaauaauaguugcauuuucuaggccaggg

SEQ ID NO: 4192519 - RNA, 79 nt, Human
cucuggcucucuggaggccauggacagguucuuuuccuucucuggacccuaguuccucugccugccaagagcagcagag

SEQ ID NO: 4192520 - RNA, 59 nt, Human
cucuggcuuggugugguaggaacugggcaccaccagcugugcacacugugaaguagggg

SEQ ID NO: 4192521 - RNA, 57 nt, Human
cucugggaaguagauuuggccuuacaaagaaaaguuuucuaucauacuugcccagag

SEQ ID NO: 4192522 - RNA, 61 nt, Human
cucugggaccauggcaagugcggcaaguucuuagagcaacacuggcugccaugauccaggg

SEQ ID NO: 4192523 - RNA, 82 nt, Human
cucugggcaggaacaaucuuacuacuauuguuacuuuuaauaauucuaauaauagggucacaauuguauuuuuuucccagag

SEQ ID NO: 4192524 - RNA, 69 nt, Human
cuagaacccguguuccccggugccacgggugcucguggugggaucccuggcucccggaacagggucugg

SEQ ID NO: 4192525 - RNA, 65 nt, Human
cuagaagcaacuagaucuguuucaaaacugggaacguccacuaacagaaacuaguugacuguugg

SEQ ID NO: 4192526 - RNA, 116 nt, Human
cuagaagggccuuacgggguuggaaugggagacuuuagcuguggccagcucagacuccacuugcugggcucccaggggcuggacaagcaggucuuccucccccuguacccuccugg

SEQ ID NO: 4192527 - RNA, 65 nt, Human
cuagaagugcaagaucaaggugucaggagguuugguuucuccugaggccucuccuuggcuuguag

SEQ ID NO: 4192528 - RNA, 82 nt, Human
cuagaaguuaacauguguagguauacaaaauucuuagagaauuauguagguaucuauauaaugguuaauuaugaaaauuuag

SEQ ID NO: 4192529 - RNA, 75 nt, Human
cuagaaucaguaggccaagcagcuggcacugaccaaaagaagggccuaggcuaggcugcuggccacugaggcugg

SEQ ID NO: 4192530 - RNA, 66 nt, Human
cuagaccaggggagucaacaggugcugcacauuaagaccugguuuauuguuuuguugauugucuag

SEQ ID NO: 4192531 - RNA, 62 nt, Human
cuagacuguuuuaggaggguagagaauaugucugcuuaacucauccucacccucaguccuag

SEQ ID NO: 4192532 - RNA, 62 nt, Human
cuagagaaaccccaugagcuuuuggagauuggagucuaucugagaguuuggggucauuuugg

SEQ ID NO: 4192533 - RNA, 57 nt, Human
cuagagaaaggcaguggagcaagaguaaauguuucuggguuuuguuuccuucuuuag

SEQ ID NO: 4192534 - RNA, 61 nt, Human
cuagagacagauagggugaugagggggauugagucuucauaauuaccuugucugcccauag

SEQ ID NO: 4192535 - RNA, 66 nt, Human
cuagagcccuuucuccaggcaccugccaccuaggggagguuuccugggacagaagaggagcugugg

SEQ ID NO: 4192536 - RNA, 70 nt, Human
cuagaggcugcccacaguucucugccauguggccaucuccacuggccuuuuacaacguggcaacuucuag

SEQ ID NO: 4192537 - RNA, 64 nt, Human
cuagagggauguuaggauagcaccaaagagacauucuauuuguuucccuaaggucuggcucugg

SEQ ID NO: 4192538 - RNA, 59 nt, Human
cuagaguccuccuggaaaagguacuucugauguaaaagaccucagggaaagguuucuag

SEQ ID NO: 4192539 - RNA, 92 nt, Human
cuagauaggcauuucuacuccuaccugcagccaacuuucuuccaaaaugaaagcaaggccacuauugcagaagcagagaguugccaauuuag

SEQ ID NO: 4192540 - RNA, 130 nt, Human
cuagaucaguuugaaagucauuucaguagccugggccagggaggugucuguagcaucugaaccaaaugaaacucagaagauauggacacauucuugggucagacaaggagaaaugagcgaacugguugug

SEQ ID NO: 4192541 - RNA, 69 nt, Human
cuagaugcuauuauggcaguguuuuuaauacccuugaguugaauaaugauauugugaugaugucuuugg

SEQ ID NO: 4192542 - RNA, 108 nt, Human
cuagauguuggaaauuaauuaucucugaaaggguuaucauuguggacacuugcuuaauuuguaaaauauuugcuacucuugauugauuuagucuuuuucugacuuuag

SEQ ID NO: 4192543 - RNA, 65 nt, Human
cuagcaauaugcuaccuuaaauguugauugaauucaucaguauauuuauggauagguacugcuag

SEQ ID NO: 4192544 - RNA, 58 nt, Human
cuagcacagcccauucagucuaaagcuucuagugagcaguaauacuggcuguagcugg

SEQ ID NO: 4192545 - RNA, 73 nt, Human
cuagcacuucauucuuuaccaaguugucacucuaucacugcaagcgugaggauuggugaaaaguauuaagcag

SEQ ID NO: 4192546 - RNA, 78 nt, Human
cuagcagcccaggccucacauugggcuucaagucuucuucaauauaaaauuucaaccagguguguggccuggcucugg

SEQ ID NO: 4192547 - RNA, 108 nt, Human
cuagccagcuggcugccaauggugauguauagagaugacuugauuugaccuugaagggaagaaacaaauuaaugugucucaaaauaaauuccggcaaucgguggcugg

SEQ ID NO: 4192548 - RNA, 86 nt, Human
cuagccaggagacauguuaguuaguaggagauagagggaacuuccugcuccugaauuacacuacuacaugucuacugauaagcgag

SEQ ID NO: 4192549 - RNA, 64 nt, Human
cuagccaugggcauuaaagguauggauguccuuccucagggcaccuuugauacccuugguaugg

SEQ ID NO: 4192550 - RNA, 86 nt, Human
cuagccugaucuuuacaccuucugaggggaaacuggcagugauuccucacugcagguggauaucucaucagauaaagcaggguuag

SEQ ID NO: 4192551 - RNA, 79 nt, Human
cuagcgguaaaaguuuauggagagaggcuuggcaggagccuggcuggcguuuuccaaaagcccacuugaugccgcggag

SEQ ID NO: 4192552 - RNA, 80 nt, Human
cuagcucagauauuuaagugauaaagcuucugaaauaaaugacacauuguuugaaacccgucacuuugagugucugguag

SEQ ID NO: 4192553 - RNA, 56 nt, Human
cuagcugugguuagauagaguccucauuccagagggcuggcaguaagcacacgcag

SEQ ID NO: 4192554 - RNA, 56 nt, Human
cuagcuguguaaaccgagcugcaccagcugcagcugagcaauuguuacagagcuag

SEQ ID NO: 4192555 - RNA, 58 nt, Human
cuagcuucccuagcuaaagagguccugacuccuggauccuaugugcuggggaggaggg

SEQ ID NO: 4192556 - RNA, 68 nt, Human
cuaggaacaguucaacaguuuaacucgcuucaacagccugauucuauaagcacuugaaguguuccugg

SEQ ID NO: 4192557 - RNA, 100 nt, Human
cuaggaacuagaaaguggguggugaagacaaguggaaguaaaugcaaaccuauucccauauauguuugucgcuagauuguucccaccaauucguucuugg

SEQ ID NO: 4192558 - RNA, 76 nt, Human
cuaggagagaggcauggaacagauucuuccucacagcccugagaagaaaccaacccugccagcacuuugaucuugg

SEQ ID NO: 4192559 - RNA, 66 nt, Human
cuaggcacucacguggcuuuagcucugccuccacacugugugcuucugguccauggaagugcuuag

SEQ ID NO: 4192560 - RNA, 57 nt, Human
cuaggcagcuuugggugugaaggagcccaucuuacuugcagggucccagaggccugg

SEQ ID NO: 4192561 - RNA, 58 nt, Human
cuaggccacauuccacaaauguucugucauuaauaucugcuggaaaaagugguucuag

SEQ ID NO: 4192562 - RNA, 58 nt, Human
cuaggccaguuaggaagagaaggcagagccccuguuucuaaaucagaauauggccugg

SEQ ID NO: 4192563 - RNA, 112 nt, Human
cuaggcccaugaaauagaugagcauuuaaugagcauauugaaucaacuugugggugugcgucucuuugcagcaagcugugauuuaugugaauuuugaagccaugggcaaaag

SEQ ID NO: 4192564 - RNA, 55 nt, Human
cuaggcuagaaggaagacuggaauccauucacaacuccuuccugacuagcucugg

SEQ ID NO: 4192565 - RNA, 113 nt, Human
cuaggcuggccuuucccacuuguuugagggucagcuuccuggcaguggguuuagaauggcacugcuggguggacuuggcucucacccaugugaucacucauccuccagccuag

SEQ ID NO: 4192566 - RNA, 86 nt, Human
cuaggcugguccuagcccagcaaagggguuugagagugaccaguaggauucucuagcuuuucuuucugggcaaugaccuggcucag

SEQ ID NO: 4192567 - RNA, 99 nt, Human
cuaggcuggugccuuccccuuggggccagggcugugcgugggggacaaggccgcugcucucccuagggccgcuggcuaagaaggaaauaccugaccugg

SEQ ID NO: 4192568 - RNA, 65 nt, Human
cuagggaaggacaaccucuuccaaagacuuuguuugcuuugugugauuggcauguccuucccugg

SEQ ID NO: 4192569 - RNA, 130 nt, Human
cuagggagaauuacgauauccuacccagggagaauuaaagugucuuacccagggagaauuacggaguccuacccagggagaguuacugcgguauccuacccagggagaauuacuaugguguccuuccuag

SEQ ID NO: 4192570 - RNA, 121 nt, Human
cuagggcacugucaaagcugggggcccuuggucuaacagaggggugccuucaggacucuccccuccugcaagagcugccugaagccaucccucagauggccacccacacccagagccccag

SEQ ID NO: 4192571 - RNA, 70 nt, Human
cuagggccauggcauugcauaacggggcucugaaagacauggcugccaaggugcugucauguguaccuag

SEQ ID NO: 4192572 - RNA, 55 nt, Human
cuagggugugcagauuuugccuauagaguguacaggcaagcucacaugacucuag

SEQ ID NO: 4192573 - RNA, 76 nt, Human
cuaggguucuauuucuuaaucuuggcuggaaccaaagaaguuguuaucugccgucugaucaagagagaacccauag

SEQ ID NO: 4192574 - RNA, 62 nt, Human
cuaggucaucucagcagugaccuuuuauuccuauuggacuagaauccucugagauggaauag

SEQ ID NO: 4192575 - RNA, 81 nt, Human
cuaggucuguggugaggauucagcagggcuguggaaguagagcucucccagugucuggcagucagcauaucauagaucuag

SEQ ID NO: 4192576 - RNA, 76 nt, Human
cuaggugguaggcugucucuugauucagaaagauuucuguuggacauauucugagagagggucagaugcuauggag

SEQ ID NO: 4192577 - RNA, 70 nt, Human
cuagguuauaaauugacacacuggcaucaaugcaguccuaggaugccagugugccaauuuacagcugaag

SEQ ID NO: 4192578 - RNA, 56 nt, Human
cuagguucuacuaguaagugucccagcugggagcucuauuacuuuguauagccuag

SEQ ID NO: 4192579 - RNA, 56 nt, Human
cuaguaaagcuaugauucugccuuuaacaaaaaaugugaaauuguugcuuuacuag

SEQ ID NO: 4192580 - RNA, 68 nt, Human
cuaguccuggaccgagacagggugggcucgggccacacaugagaccucccguauauguccugggcuag

SEQ ID NO: 4192581 - RNA, 66 nt, Human
cuagugguaauucugugagauggugcagauguaggauauuuccaccggcucaggaaguucuauugg

SEQ ID NO: 4192582 - RNA, 99 nt, Human
cuagugguuucuugugucuaugugcccucuuagagucucugguucagaaucacaucuuacagugggcuuucagagugcucaucuuacagagauaacugg

SEQ ID NO: 4192583 - RNA, 69 nt, Human
cuaguguucggucuuguguaaacacuguuacagcggauguuacaguguguccuaaaggucuggacuuag

SEQ ID NO: 4192584 - RNA, 55 nt, Human
cuaguuaaggagucacuuggacucacuuuugagucuuggcuguaccauugacuag

SEQ ID NO: 4192585 - RNA, 66 nt, Human
cuaguuacaauuaugcauggaaaagcagcuaggugaagcuuuucuucuugugucuauuguaauuag

SEQ ID NO: 4192586 - RNA, 77 nt, Human
cuccuggcgucuguacaucccgagagccaguaucuuccaagcugagguuugucuugggaugugacagcagucaggag

SEQ ID NO: 4192587 - RNA, 65 nt, Human
cuccuggcucgcccccagcugaggauugcugcacagagaaauagucacuggacgugagccagggg

SEQ ID NO: 4192588 - RNA, 57 nt, Human
cuccugggcuaugucugcuuggacucaccauugcauccccagcagcuggcacaggag

SEQ ID NO: 4192589 - RNA, 59 nt, Human
cuccugggcuggggagggcacgcugcagccugcacuuugucuccagaaagcaccaggag

SEQ ID NO: 4192590 - RNA, 67 nt, Human
cuccuggggugcugaugaagauguagccuuccuuugaagcuagucauucagaucagcucuacagggg

SEQ ID NO: 4192591 - RNA, 87 nt, Human
cuccugggucccacugcuugccucccucagcucacagcugguauuacuagcucuguguggacagggaggcugcagagggacggggag

SEQ ID NO: 4192592 - RNA, 59 nt, Human
cuccugugugcaggcacugugccagauagaaauuugucagugccaaaaugcaugaagag

SEQ ID NO: 4192593 - RNA, 100 nt, Human
cuccuuagauccccggagcucaggacuggaggagcggggcuuguuuucaccuugaccgacccucucccgccuccggcuucuugugcgagggaccugggag

SEQ ID NO: 4192594 - RNA, 61 nt, Human
cuccuuagcauccaagcugguguuccaaacagaaagauccaaggcuuggcugcagagagag

SEQ ID NO: 4192595 - RNA, 67 nt, Human
cuccuuaggggcuaucaggaaauguauuuuuugcuguuuugaaagacauuuugauaccccuaccgag

SEQ ID NO: 4192596 - RNA, 70 nt, Human
cuccuuccaacaagagaaagagcccuuccccuugaaucuggcuuguccuguuacuuguuuggaucaggag

SEQ ID NO: 4192597 - RNA, 56 nt, Human
cuccuuccaccccacugaaguggacaccugccucuggagcccagggugagaaggag

SEQ ID NO: 4192598 - RNA, 80 nt, Human
cuccuucccgccugcauccuucccauuuaaaccagggcuucuuggcuuggauguggagggugaugggacugggaaguggg

SEQ ID NO: 4192599 - RNA, 68 nt, Human
cugaguacuuugaugcuguuguaugugugagaccaucucauaagcaaauaaugcaucaaggguuuugg

SEQ ID NO: 4192600 - RNA, 58 nt, Human
cugaguagcgcaguggguuacagauggccauauagcgaucauagcccauggcugccag

SEQ ID NO: 4192601 - RNA, 130 nt, Human
cugaguaguugggauuacaggcucccgccaccaugccuggcuaauuuuugguauuuuuaguagagacgggguuucaccaucuuggccaggcuggucuuguacuccugacccugugauccacccaccucag

SEQ ID NO: 4192602 - RNA, 64 nt, Human
cugagucacaguagaucaucacuuauuauuguucccacuuuagagaugaggaacugaggcucag

SEQ ID NO: 4192603 - RNA, 71 nt, Human
cugaguccuugggcuuagagugagcaugagaaugacccuuaggcccugcuuucagaccccagagggcucag

SEQ ID NO: 4192604 - RNA, 59 nt, Human
cugagucgaguccugcuugguugggaauuuauuucuaaacacuacgggauuugggucag

SEQ ID NO: 4192605 - RNA, 60 nt, Human
cugagucuucucuucuucuagaggccuaggcugcugguccaguaaggguggagagaccag

SEQ ID NO: 4192606 - RNA, 57 nt, Human
cugagugauagcgauggggaaccauugaaggauuuccaucacaagcuaaucaauuag

SEQ ID NO: 4192607 - RNA, 77 nt, Human
cugagugcaccuucaucaccaucaagccagacagugugcagcauggccuggcuggcaagaucgugaagugcuuugag

SEQ ID NO: 4192608 - RNA, 55 nt, Human
cugagugcuuugucuuguaauucuucagcugaaaacuacaacgccaggcacugag

SEQ ID NO: 4192609 - RNA, 70 nt, Human
cugaguguuuucagccacggccuugauaccuguacaaaggagauaauacccguaucuggaaacuacuuag

SEQ ID NO: 4192610 - RNA, 67 nt, Human
cugaguucaaauucuggcuucuuguuagcuguguaccacugaacacauuacuuagccagagucucag

SEQ ID NO: 4192611 - RNA, 81 nt, Human
cugaguuucuuuccccuuugucuuccuguggguuuggcuaaugagaggcccugagaagaagucggagggcaagagaagcag

SEQ ID NO: 4192612 - RNA, 83 nt, Human
cugauaauaguuaugugagguagauaggaugcagaauaaauuuuccguuuguaaccacgucucccucauuuuaauauuucuag

SEQ ID NO: 4192613 - RNA, 82 nt, Human
cugauaaucuuggaauaccccgaaggucauuucaucuaauuuuucaaacuguaaaugacuuggcuaauuuuaggauuauugg

SEQ ID NO: 4192614 - RNA, 70 nt, Human
cugauaauuuugcuuuuugguucuuuuuuguuccuucagugaaauggcagcccagagguaagguagucag

SEQ ID NO: 4192615 - RNA, 58 nt, Human
cugauagccuucucugauucuccuagugaaaaaucacaggcauuuggaagguaaucag

SEQ ID NO: 4192616 - RNA, 81 nt, Human
cugauaguguguguucaaggauuauacaggaucgagucuccuuaggagaugauguccaugacugugacucacauggaucag

SEQ ID NO: 4192617 - RNA, 55 nt, Human
cugauaugacaaagugccuugccaccaauacccagccaggcacugucccaugcag

SEQ ID NO: 4192618 - RNA, 58 nt, Human
cugaucacuuucucucaccacgugggucauuugugguggcaaaguacaaagugaccag

SEQ ID NO: 4192619 - RNA, 79 nt, Human
cugaucaugcugggcagauuaaugcaguggcuguuguuuauugacuggucaguguuucaucugugaaagucaagauuag

SEQ ID NO: 4192620 - RNA, 67 nt, Human
cugauccuaguuugcuccaccguaucaaucuucagugucauugauuacaguggguaaacagaauuag

SEQ ID NO: 4192621 - RNA, 97 nt, Human
cugaugagaaucugaggucaggaagaugaguagcauggagggcugauaugagcacuaggggugggcugugucuguuuuacgucaagauuaacaugag

SEQ ID NO: 4192622 - RNA, 56 nt, Human
cugaugcacugucuucccagaguuaacugaugugcagugugaauccaguguuucag

SEQ ID NO: 4192623 - RNA, 65 nt, Human
cugaugcagcuucaggauuaugaugcagaaauuuucugcuguggcuccauagaaguugcaaucag

SEQ ID NO: 4192624 - RNA, 58 nt, Human
cugaugcuuuacgacaaaaaacucagcaagcucaguucuuuggucguaaagcuacuag

SEQ ID NO: 4192625 - RNA, 116 nt, Human
cugauggaagugacgcuccucacauccagcuccagcuucugcaccaaggcgcuggggucuaucuugguccuggcaaagauguugguguugaugaacggagguauaauucuuauuag

SEQ ID NO: 4192626 - RNA, 69 nt, Human
cugauggccaggguggcacuguggucggcaugugucagcaacaucagagucacuacucguggcccucag

SEQ ID NO: 4192627 - RNA, 100 nt, Human
cugauguaaugaggccuccccucuauccuuaucugucugguagagucauucugggcugacugggcaccaucaugagaugggcaggaggucucaucauugg

SEQ ID NO: 4192628 - RNA, 68 nt, Human
cugauuacaacagagucauccauggauucaaacuaguccucuuuccagggaugacuguguuuaaaagg

SEQ ID NO: 4192629 - RNA, 66 nt, Human
cugauuacaguagacaauguuaguaugcacagcuugcucugcuacaugauauaggucucugcacag

SEQ ID NO: 4192630 - RNA, 61 nt, Human
cugauuacuuuuugucucuuugaaugugccuauucuggacauuucauauaaaagggaucag

SEQ ID NO: 4192631 - RNA, 56 nt, Human
cugauuaggcuaagcaagagggugcacguggucauuugaaggcuuugucuaaacag

SEQ ID NO: 4192632 - RNA, 60 nt, Human
cugauucgcuaucauuccagcucaugucagagccgccuggaaucuucgauauugauucag

SEQ ID NO: 4192633 - RNA, 83 nt, Human
cugauucgugaaucauucauugcucaauuaaguuccuuuaaauuuaauucagcugaagauuuucuuuuaauagauggugucag

SEQ ID NO: 4192634 - RNA, 56 nt, Human
cugauucuuucuucuugccaggggcaccccucugaugcagggagugaauggaucag

SEQ ID NO: 4192635 - RNA, 91 nt, Human
cugauucuuugcugagauuggaagcuagauuggcauucauuucuuaagcuggaaaccugugcugauuuguuagaaaugcugcaaggaacag

SEQ ID NO: 4192636 - RNA, 85 nt, Human
cugauugggggggaauuguaugaggauagcaagaagcuucaaauaauuaugccagccugcugaaccucaugcagucucugauugg

SEQ ID NO: 4192637 - RNA, 125 nt, Human
cugauuguaugaauuuuaauuguucaguuaacguguuucuagguuguaauuuguaguaaagcacuucaaugcuuuugcacuuaaauuuacaacacuguuggugugugauugauuuacucauucag

SEQ ID NO: 4192638 - RNA, 80 nt, Human
cugauugucagggcuggagcuuccaggcacaagcuccacuccucaccuggcccugggagcucacaggccuggcuccacag

SEQ ID NO: 4192639 - RNA, 58 nt, Human
cugauugugcagagguguaauugaaauguuuuguucaauguuacacagguauaaucag

SEQ ID NO: 4192640 - RNA, 99 nt, Human
cugauuuagaacugaaugcggaugguuuagaacuagaugcaggugguuuaauacuagaugcagcugguuuagaacuagaugaagguaguuuagaaguag

SEQ ID NO: 4192641 - RNA, 65 nt, Human
cuaguucagugguggauuaugucaauuaauuaaauuagacaucauaugauucagcauuguguugg

SEQ ID NO: 4192642 - RNA, 70 nt, Human
cuaguuccugauaugaugggugauuuucaauuguaucuugaaaauguuucuauuauaucaugagacucug

SEQ ID NO: 4192643 - RNA, 56 nt, Human
cuaguucuagaucccugaggaaucgcccacacugacuuccacagugguugaacuag

SEQ ID NO: 4192644 - RNA, 55 nt, Human
cuaguucuagaucccugaggaaucuccacacugacuuccacagugguugaacuag

SEQ ID NO: 4192645 - RNA, 64 nt, Human
cuaguugcugccacugggagcaaaugugcuuagucauugugcaccaccuuguggcagcguuuag

SEQ ID NO: 4192646 - RNA, 87 nt, Human
cuaguuucacaucccaggcauucugugaggcacuggggauagugaccguccucaggaaggcuucacacgagugcugucagaaacaag

SEQ ID NO: 4192647 - RNA, 123 nt, Human
cuauaaaaauucuucuguauauuugauugaaagugaagaaauaccuugcuugaaguaguuguucugaauauuuugaaguguuauuucuaucacuuuaaaauugaauuuauuguaucuuuauag

SEQ ID NO: 4192648 - RNA, 105 nt, Human
cuauaaaagucuuaaaaguauucuacucuaaauuccucccuuugcacaagagggagcugaaguagggguaaauagaaugcugucacaaagauacacauuuaauag

SEQ ID NO: 4192649 - RNA, 94 nt, Human
cuauaacaaguuaggcauauucugaauccucgaaacauagcaguuaaacuuugcugacuaaauuccuguucgcgaugagcuuaauuucuugugg

SEQ ID NO: 4192650 - RNA, 56 nt, Human
cuauacagagcauccuuaacuuuucucaagguuaggcucugaaguguucugugugg

SEQ ID NO: 4192651 - RNA, 56 nt, Human
cuauacauuuuaacuccuuuuaggcgucucagugagaaggcaucagaaguguguag

SEQ ID NO: 4192652 - RNA, 59 nt, Human
cuauagaugucauuuuacauccacugcauggugggcacugaauuucuuggcaucuuugg

SEQ ID NO: 4192653 - RNA, 73 nt, Human
cuauaggaggcaaguacuguuuuuaucuccauuuuagagauaaacugaggcaguauuuuagugacuuagguag

SEQ ID NO: 4192654 - RNA, 64 nt, Human
cuauagucuuaacuauucaggaggcugagguggaucacuugagccuuggagguugaggcugcag

SEQ ID NO: 4192655 - RNA, 78 nt, Human
cuauauaugcauuuuguaagauaugaguacauguaagugggucuguauauguguauauuuuaaaaaguguuccuuuag

SEQ ID NO: 4192656 - RNA, 69 nt, Human
cuauauuauguguuguugugaagauuaaaugaguuaacauaaagcacuuuagaacaauauuugguauag

SEQ ID NO: 4192657 - RNA, 74 nt, Human
cuauauuucauuuacauuguugagccucuuguucagccuacuaaugugguuggugcuuaacaaauguuguaugg

SEQ ID NO: 4192658 - RNA, 58 nt, Human
cuaucaaaaggaguugaaaggggcuuccuuagacccugaccaccagcuccauuuguag

SEQ ID NO: 4192659 - RNA, 73 nt, Human
cuaucaauacauguuaucaguguucucuggggguauuaaguuccagucacccauaguguaacuugauugauag

SEQ ID NO: 4192660 - RNA, 82 nt, Human
cuaucagggcaguaaagauuucagaagccugugccaugucagugacugggaggcauuuuggaacuuucuggcagcccuguag

SEQ ID NO: 4192661 - RNA, 56 nt, Human
cuaucaucauagugauugggaggguggauuuuuccccagaguauuugugauguuag

SEQ ID NO: 4192662 - RNA, 75 nt, Human
cuaucaugaucuccagaacauuuauaaacgaugaaaccuuaucucuugcaauaguuucugguaggaauaugauag

SEQ ID NO: 4192663 - RNA, 73 nt, Human
cuauccuauuauugacccuuucauuauucucauugccaugguguagaaaagggaaggguuucugcaggagugg

SEQ ID NO: 4192664 - RNA, 67 nt, Human
cuaucgacauucucugauuggugccucccugaacucacggacaaaaaucaggguaaugaugagguag

SEQ ID NO: 4192665 - RNA, 74 nt, Human
cuaucguaaugcacauauauuuccuuauucugccauaauaaguagaaucaacaggaugugcauuguaaagguag

SEQ ID NO: 4192666 - RNA, 55 nt, Human
cuaucucgugauagguuuuaugugguuacuugaccaaaaagacaaaacgaguugg

SEQ ID NO: 4192667 - RNA, 101 nt, Human
cuaucucugccacuucuuauuuguggcauaugagacgagucucuuaauaccucugagccucaguuuccucaucuacaaaagagaaaugguaccagugauag

SEQ ID NO: 4192668 - RNA, 91 nt, Human
cuaucugaggguguaaauuauaggugccaccuuggagguuggugaucacaguccaucuuuuggguucuuaugauuuauaucccuuccauag

SEQ ID NO: 4192669 - RNA, 62 nt, Human
cuaucuggaagucagagguuugcaguccauuucugaauugcuaaagcuauauucccagaaag

SEQ ID NO: 4192670 - RNA, 93 nt, Human
cuaugaaacauggaauuucagugguuugaugauguauaucacuuuuuuugaaggcuuauguauuucaaacuuacugcauuuuuuaggguauag

SEQ ID NO: 4192671 - RNA, 117 nt, Human
cuaugacacugucucuucuucuuaaccaggauuuaagauucuagagggcugagaugguuucuuacaaauucuugaguuuucaaucauugugugcaguacaaggcauggaugucauag

SEQ ID NO: 4192672 - RNA, 130 nt, Human
cuaugacaucagaauauuucagaauaagucuucaguuuagaaccaggguuacgauucuuuuuaaagaggauuacuuuauauguauuucuguguugcuuugaaggaucccugaguaauuucuaugcaugug

SEQ ID NO: 4192673 - RNA, 79 nt, Human
cugacucugggagggagggacuagcauucucuuuaguuuacagagaggugaagucaccuuccuauggucacacaguuag

SEQ ID NO: 4192674 - RNA, 59 nt, Human
cugacugcuuuuuuaagaguauacugugggguagcggcagauacaagagagcaguugag

SEQ ID NO: 4192675 - RNA, 55 nt, Human
cugacuggcauaaagcaaccacuauuuuacugugcuugcaaauaucgugggucag

SEQ ID NO: 4192676 - RNA, 71 nt, Human
cugacugucccuggagauuuuuuaguggcgcagaggucauuugacaacuucugguggcauccaagugucag

SEQ ID NO: 4192677 - RNA, 104 nt, Human
cugacuugacagccuggccguuccucagggccagggaucagucgaggccaaaguaucacuugauccuucccugaaaugccucugccaaucuguagccacaucag

SEQ ID NO: 4192678 - RNA, 62 nt, Human
cugacuuggagauacagaggacauuuggauucuguacuaagguccaugaauaucuaagccag

SEQ ID NO: 4192679 - RNA, 68 nt, Human
cugacuuggcugcauaaaacagacccuuauaauaccaggucacauguauaugcagcacagcuugucag

SEQ ID NO: 4192680 - RNA, 55 nt, Human
cugacuugguucauauccugggguccguaaacccacacugauagcacuaagucag

SEQ ID NO: 4192681 - RNA, 69 nt, Human
cugacuuguuaacucucaaagaacaugacucuuuguguuuagcauguuuucugaugguuaaugagucag

SEQ ID NO: 4192682 - RNA, 69 nt, Human
cugacuuuuccaaauaauacuuccucugacaacacuuucaaagugguaagauagcuuggaaaaguacag

SEQ ID NO: 4192683 - RNA, 77 nt, Human
cugagaaaugcaaacagccuugaaagagggacacaccuaaggcagugauucucaaagggugguuugcaaacuuuuag

SEQ ID NO: 4192684 - RNA, 57 nt, Human
cugagaagcacugucugcaagaaaccuaaucugggcaugggacagcugccuucucag

SEQ ID NO: 4192685 - RNA, 58 nt, Human
cugagaagccuguucuuaagcccaguccaaggcuggccucuggagaagggcuuuccag

SEQ ID NO: 4192686 - RNA, 57 nt, Human
cugagagacuguuuguaauauuuagguguuaaucaacaacaaacaguguucuuucag

SEQ ID NO: 4192687 - RNA, 95 nt, Human
cugagagcagagguggucggggaagcccggccugcacaugggggcccucaggagccuuccaggugcuggccuggccucugaagcuugugguccag

SEQ ID NO: 4192688 - RNA, 75 nt, Human
cugagaggcccugaagcccacagagagaggccaagauacucucacugacucuggguggcuucagaggccacugag

SEQ ID NO: 4192689 - RNA, 67 nt, Human
cugagaggggaccaggguguuucuuggcagucccuccuggacccugccugcccuugucugcccucgg

SEQ ID NO: 4192690 - RNA, 111 nt, Human
cugagaguauaaggcacucacuaguagagcacauguggagagucugggcccaguccuugcucugggaucugccucauucucgcguguguuucugucaacccucucucuuag

SEQ ID NO: 4192691 - RNA, 87 nt, Human
cugagaucagcauccucacugaggucagcccuuccuaugauccugcacaaggaacaagguggggcuguuucagagaguuccucucag

SEQ ID NO: 4192692 - RNA, 85 nt, Human
cugagaugauagagcuggauuuuaucauuguaguuuaugccaaugcuuaaacaccauguaaaaagucuuaaccucauucuuccag

SEQ ID NO: 4192693 - RNA, 79 nt, Human
cugagaugucugagacucagccccugcucucaaggagcucagaguccauugggagaaauaguugauccgcagcauccag

SEQ ID NO: 4192694 - RNA, 58 nt, Human
cugagauuugguuuuguucacugaugcauccucugugucuacaacaaugccaauccag

SEQ ID NO: 4192695 - RNA, 90 nt, Human
cugagcagcaugcaugauguuggcaguggcaauagagggggcaagccaacccuugagcucccuggcagcaaucacugguguuagcugcag

SEQ ID NO: 4192696 - RNA, 64 nt, Human
cugagcaguccagaaagggcagugauuugaauguugggaacacauuuuccuuuguggagcucag

SEQ ID NO: 4192697 - RNA, 72 nt, Human
cugagccagggcucaggaaaucagacguacucauuugaaugauucagcguuuggaccugagucaaaugccag

SEQ ID NO: 4192698 - RNA, 69 nt, Human
cugagccccaggcuuuuccguaaacagcaggagugggaccucuucuucaggaagagccuggacucucag

SEQ ID NO: 4192699 - RNA, 63 nt, Human
cugagccccugcaccccugcccacccagguggaggaauguggcaggggcugcugggaacucgg

SEQ ID NO: 4192700 - RNA, 64 nt, Human
cugagccuguugucagcccuggagcggcugcuccgucaggcagcucaggcuggcagcaggcuag

SEQ ID NO: 4192701 - RNA, 65 nt, Human
cugagcugagcugggcugagcugggcugggcuaggcugggcugagcugggcugggcugagcugag

SEQ ID NO: 4192702 - RNA, 56 nt, Human
cugagcugugucuuggugagagucuucagcuuacuccacauuugaacacaguucag

SEQ ID NO: 4192703 - RNA, 98 nt, Human
cugagcuuaguauguaagauggcaauaguaccaaguguaagucaaggaaccuaugcuccaaagacauguugccacuuuucuuucuauccuaggucaag

SEQ ID NO: 4192704 - RNA, 86 nt, Human
cugagcuuccuagcaagucucugauguguguuagguguuacuguuaccauuucauggaugagcagacuguggcuggaggagaccag

SEQ ID NO: 4192705 - RNA, 83 nt, Human
cugaggaagcauggcagggcacagcucuaguugacagauguuuuagguacaaauagaaguugggccauugcuggcuguaucag

SEQ ID NO: 4192706 - RNA, 82 nt, Human
cugaggacucaaguuaacugcuuugugagcuuucuggaggcagaaccuccaagcccauccaaauuagaugauguauccucag

SEQ ID NO: 4192707 - RNA, 56 nt, Human
cugaggagggaaguccccaaagcacacacgcaguaaguugggcuuucccccuuuag

SEQ ID NO: 4192708 - RNA, 58 nt, Human
cugaggagggagauaggucaggggcccccucaggucaccacuuucuccuucuccuugg

SEQ ID NO: 4192709 - RNA, 61 nt, Human
cugaggaggggccugagugagaccugcaggugagguucuuugagacaaagggcucucucag

SEQ ID NO: 4192710 - RNA, 61 nt, Human
cugaggaguuggugaauaagccccagccauucggaugggcaggcuuuccacgggcucccag

SEQ ID NO: 4192711 - RNA, 58 nt, Human
cugaggcaagggauggccccgugcaggcuccugccaggacugccagauccugccuugg

SEQ ID NO: 4192712 - RNA, 104 nt, Human
cugaggcaggagaauugcuugaaaucaggaggcggagguugcagugagcugagaucaugccauugcacuccagcucugggcgacagggcaagacucagucucgg

SEQ ID NO: 4192713 - RNA, 103 nt, Human
cugaggcaggaggaucgcuugaacccgggaggcuaagguugcagugagcccauauggcgucacugcacuccagccugggcgacggagcgaaacccugucucag

SEQ ID NO: 4192714 - RNA, 69 nt, Human
cugaggccaugcaucuauucccaagggcagacacaaagguuugagcucucugaauagaucagccagcag

SEQ ID NO: 4192715 - RNA, 70 nt, Human
cugaggcccagccuggucuuggggggcgcuggaggaacacagcugcucuccccaggccagucugacccag

SEQ ID NO: 4192716 - RNA, 60 nt, Human
cugaggcuccagcgacaccuaggcccccaggagguuagggggccaggccuggaccugcag

SEQ ID NO: 4192717 - RNA, 85 nt, Human
cugaggcuggagaagggaggcgagucuuagugaguucccuuuaagcucugagacaacagaggccgccucucucacggccuuccag

SEQ ID NO: 4192718 - RNA, 61 nt, Human
cugaggcuggagugcaguggugugaucucagcucacugcaaccacugccuccaagguucag

SEQ ID NO: 4192719 - RNA, 79 nt, Human
cugaggcuggaguucaguggcaugaucuuggcucacugcaaccuccagcucccagguucaagcgauucuccugccucag

SEQ ID NO: 4192720 - RNA, 80 nt, Human
cugaggcuucagcccugccucuccaaugcccacagcuuccugcuggcacuggaguugggguggaggggaggaagccccag

SEQ ID NO: 4192721 - RNA, 59 nt, Human
cugagggaauucacuggaacgcccugucucugacaguacgauuucuugaguuucuugag

SEQ ID NO: 4192722 - RNA, 66 nt, Human
cugagggagagaaguuauacaagauuuuaucaauuuccaguggcaucaugugcuucucucgcucag

SEQ ID NO: 4192723 - RNA, 76 nt, Human
cugagggaugggauaauguuauuuucuugucaguggucacaagcuauauggcauuacauuguuaaaucucccccag

SEQ ID NO: 4192724 - RNA, 78 nt, Human
cuguaccccuuguucuacuccaagugcaagaaaaaucuaagcuuuuuacccacaugaguguaggaagagggaagacag

SEQ ID NO: 4192725 - RNA, 99 nt, Human
cuguacuauuauuucucauggagcaagaacucauuuucacuuuucuuagugccuaagacuaguugaaugguuuucuguugccauaguaacacuacucag

SEQ ID NO: 4192726 - RNA, 68 nt, Human
cuguagcagacucuguggccucuccaacagccuagauccugagggguggccaaggacucugaccacag

SEQ ID NO: 4192727 - RNA, 63 nt, Human
cuguagcuacacaucuaaacagcaacucguuaggguuuaagguaacacagaugugugcagcag

SEQ ID NO: 4192728 - RNA, 81 nt, Human
cuguagcuuuuugguguauguguauuugugugugugcaugcauauguguacaugcuuugcacuuacaucaugagcagacag

SEQ ID NO: 4192729 - RNA, 65 nt, Human
cuguaggagugggaauuuauugagcaugagggaugcuaucuugugaaacuuucuacuucauucgg

SEQ ID NO: 4192730 - RNA, 83 nt, Human
cuguaggauacacuuaaucuuacugaggaucaaauuaagaaauguuauuuguucuaacagcauggauuaggucgguucaacag

SEQ ID NO: 4192731 - RNA, 58 nt, Human
cuguaggauccuggcccaaagcucugcauaucuuggagagucugaggaggaccaacag

SEQ ID NO: 4192732 - RNA, 72 nt, Human
cuguaggcccugccucugccuuugcugggaagaagcacacacuccugcccugcaugcagggagcugucacag

SEQ ID NO: 4192733 - RNA, 92 nt, Human
cuguaggcucuucuccagguccagguuccguuucugcgggucgcucugccugagcugcgggcucugcggccucaaggacuggacgcccacag

SEQ ID NO: 4192734 - RNA, 69 nt, Human
cuguagggcugagagaaggccugggggucuccuugcagugcccuguucauuucucucccuccugugcag

SEQ ID NO: 4192735 - RNA, 86 nt, Human
cuguaggucggaaaucugaguguggccuuacuagguucucuggcucagggucucucccaagggcacauucaaggggccaucuacag

SEQ ID NO: 4192736 - RNA, 64 nt, Human
cuguaggugauugcuauguuaugugcugcuucagugcacuucaguuccugguagucacuuagag

SEQ ID NO: 4192737 - RNA, 68 nt, Human
cuguagucccagcuacucaggaggcugaguugguaggaucauuugagccagagagguugaggcuauag

SEQ ID NO: 4192738 - RNA, 59 nt, Human
cuguagucuagguauuguccuccucgugagguggacacagguaaauaccacugauacag

SEQ ID NO: 4192739 - RNA, 62 nt, Human
cuguagugcuggucuguccaggggcuuuucuuuucucuaauucaaccagacacuuauaacag

SEQ ID NO: 4192740 - RNA, 87 nt, Human
cuguaguucagauuucaaaggcuuugcuaugaugcauuggauuuaucuuguguaagcacagcuuagaaauuaucuuggaacuugcgg

SEQ ID NO: 4192741 - RNA, 55 nt, Human
cuguaguugggcauuauaauaguauuauuagauaauuuuagagugccaauuauag

SEQ ID NO: 4192742 - RNA, 57 nt, Human
cuguauccauuaguaauccugcagguucuuaaagggacacugcauugauggaaacag

SEQ ID NO: 4192743 - RNA, 73 nt, Human
cuguaugguuuauaggacagcucuguaguuuuucacuugauucucccaacagggcugucuauauuuuuuguag

SEQ ID NO: 4192744 - RNA, 58 nt, Human
cuguauguguuuuguaugagugugauuuacaugugugcucauacacaugagcaugcag

SEQ ID NO: 4192745 - RNA, 91 nt, Human
cuguauguuccucuggugugcugcuucauuuauaugcuuuccuauucuuuuuaugagggcugugaaggagcggguuagcauuugacaacag

SEQ ID NO: 4192746 - RNA, 74 nt, Human
cuguauuaaaugccuaucucauagagaugucauuauguugaaaugauacaaucaugagagaggacauugcauag

SEQ ID NO: 4192747 - RNA, 62 nt, Human
cuguauugauaaggauggcugcaauuaucgccuuaacuagccaugguccccgucaaggacag

SEQ ID NO: 4192748 - RNA, 73 nt, Human
cuguauugcauuugacaaauuauuuaaccucucugguuaugagagguuaaauauuauguugucugcaaaauag

SEQ ID NO: 4192749 - RNA, 82 nt, Human
cugugccuuugaaauaucaaguuauuagugaccaacaaauaaaguaggauacucagacuugaaucucaagagaaagguagag

SEQ ID NO: 4192750 - RNA, 72 nt, Human
cugugcgaugcuguaggagugugguaaacaucucauaaaucuucauggcacugcucgcugcagcauggccag

SEQ ID NO: 4192751 - RNA, 78 nt, Human
cugugcucagccaugucaugccuaccuguauugucccaguggcacugcgagaggagccagggcgucggcucggcacag

SEQ ID NO: 4192752 - RNA, 62 nt, Human
cugugcuccucacaguguggcccugcgacugacacggagcccagggcagcuugaggagccgg

SEQ ID NO: 4192753 - RNA, 71 nt, Human
cugugcugggcucuggaguucuagaaagaagaggaaucccucucucugggaauucacaagcccucuaauag

SEQ ID NO: 4192754 - RNA, 71 nt, Human
cugugcuuaaagaacauacucugaauaacauaaauccuuuuaagcuuauugagagcuguuuuauggcacag

SEQ ID NO: 4192755 - RNA, 72 nt, Human
cugugcuucucaaaaggagguagguggaccauuuucaucagauucaccugaagggcuuauuaagaaguacag

SEQ ID NO: 4192756 - RNA, 96 nt, Human
cugugcuuuauuuucauuaucaaguuuacuguguggaugaauaaagcaagacaagcaauugugucucuauuuaccagugaggaaaaugaggcucag

SEQ ID NO: 4192757 - RNA, 57 nt, Human
cuguggaaaauuggaacguuccuggcccugcuagaaggggcaacuaauucuccagag

SEQ ID NO: 4192758 - RNA, 67 nt, Human
cuguggaugggauuggccuuucacgaugcuuauaaaggaaggacuuccaaaccucccaaaucuacag

SEQ ID NO: 4192759 - RNA, 116 nt, Human
cuguggccagaaucucugagaucucuuucagcccaaugacacucugcacagugcuuguuaaacguucuugaaccuggcacacauggugguuggugaagaguccuugaggaccacag

SEQ ID NO: 4192760 - RNA, 64 nt, Human
cuguggccccucaugucagucccugcccagugcuuguucacuggugaggaagugagggccagag

SEQ ID NO: 4192761 - RNA, 57 nt, Human
cuguggcccuguggcuucagaacagagccccaccgugcugucagccuagggccagag

SEQ ID NO: 4192762 - RNA, 72 nt, Human
cuguggcuauguggcugugggaauggccuggagguagguaguggccagcacacaaggccuuguagaccacgg

SEQ ID NO: 4192763 - RNA, 65 nt, Human
cuguggcucaggccuguaagcccagcacuuugggaggcugaggcaggcggauugcuugagcccag

SEQ ID NO: 4192764 - RNA, 59 nt, Human
cuguggcucuuuaguugagcaccccgauucccuuguguucuccccuuuagggccuacgg

SEQ ID NO: 4192765 - RNA, 71 nt, Human
cuguggcugcuaagucuccuuccuucucuggaccucaggaaauaaagaggauggaaggaauggucccgcag

SEQ ID NO: 4192766 - RNA, 57 nt, Human
cuguggcuguccuaccugguagcccagcucacaugagacugacccaggacaccacgg

SEQ ID NO: 4192767 - RNA, 80 nt, Human
cuguggcuucaacugcaggacgaccgccucaucuugaggccucugggagguaggugcuguggucuccccgcuugacgcag

SEQ ID NO: 4192768 - RNA, 63 nt, Human
cuguggcuucuggccugcuacacccaugaacagagugggcuucugcagccaaagaagccgugg

SEQ ID NO: 4192769 - RNA, 56 nt, Human
cugugggagaaguugcuggaguccaaccccggaaguagcaagugccucucccacag

SEQ ID NO: 4192770 - RNA, 61 nt, Human
cugugggagcacuggggaccgagagacuuguguggacacauccccacgugcaggcccacag

SEQ ID NO: 4192771 - RNA, 88 nt, Human
cugugggauuuccuccugcagcccucagcagccaaaauguauauggagaggugggcagcuggcuugcugcaggaugcaggauuuccag

SEQ ID NO: 4192772 - RNA, 67 nt, Human
cuguggguguuaugacugcagacagaaacaaaagaaguauuuuguaauuggucauagcuuuucacag

SEQ ID NO: 4192773 - RNA, 62 nt, Human
cugugguaacccucugagugccucacccuuccuuuuccuaguaaacauaguggauaccacag

SEQ ID NO: 4192774 - RNA, 59 nt, Human
cuguggucagcuacuggucaucuaagcagcuacucuuuugcagauuggcugacugucag

SEQ ID NO: 4192775 - RNA, 93 nt, Human
cuguggucucauuuugcaaacuagaugaaacgaguaaagaucacuauugucuugucuccaucuucuucagccugguuaguaggaggaccacag

SEQ ID NO: 4192776 - RNA, 67 nt, Human
cuguggucugacaucaccugagaacuuguuacgacacagacucucaggucucaugccaggccuacag

SEQ ID NO: 4192777 - RNA, 95 nt, Human
cugugguggggagcugacaaagagguuuugagggcagcuacacugauagggaaacacucuugggcugaccucuaaccucucccaucccacuaugg

SEQ ID NO: 4192778 - RNA, 84 nt, Human
cugugguugccacuuauaggaaagaaaauuauguaggaaguucagagauucaccuacgccauuucuucccugaagaugccacag

SEQ ID NO: 4192779 - RNA, 72 nt, Human
cugugguuuuguauauauugaagacuccaauguacuggaggauuggaguauucaauauauacaaauguaugg

SEQ ID NO: 4192780 - RNA, 69 nt, Human
cuguguaaaggaggaaggggcugguuaaacaugauauuugaucugccucauucuuguucaaccuaacag

SEQ ID NO: 4192781 - RNA, 64 nt, Human
cuguguagaggagacagagcugcagcagcaggaacagcagcaugagaccuguagcuucacagag

SEQ ID NO: 4192782 - RNA, 56 nt, Human
cuguguagauucuccuucccuagggcaguccucaggagaacuuccuucuaccccag

SEQ ID NO: 4192783 - RNA, 66 nt, Human
cuguguccauuuaucauugucaugggcugaaacuuuccacuugugguaaugauuaaaaggauaaag

SEQ ID NO: 4192784 - RNA, 64 nt, Human
cugugucccugugcagaaaugucacauggaguccugucaugucacaugagagcgcagcacacag

SEQ ID NO: 4192785 - RNA, 92 nt, Human
cugugugacucaccauuugcucagacagacauuugagggucacgcuuuuccauuaagguuuguggggagcaaaagauggguagauaaaauag

SEQ ID NO: 4192786 - RNA, 59 nt, Human
cugugugagcaucaaagccugucaucacuuuuauuggcaggugccaugggcucagacag

SEQ ID NO: 4192787 - RNA, 75 nt, Human
cuccucaggugccaagaucugaauaauuaagaggagagaaaaccugugacuccucucaucugccauuugcaggag

SEQ ID NO: 4192788 - RNA, 61 nt, Human
cuccuccacccgcuggggcccaucgucuucauccgaguccuggcgcccugggcuggagggg

SEQ ID NO: 4192789 - RNA, 68 nt, Human
cuccucccaggccuaggcaguauaaaaaaagguguuaaggggcuguuaacaauagggcugggaaggag

SEQ ID NO: 4192790 - RNA, 56 nt, Human
cuccucccucuuugccacacauuuccuauggaaagacugucacggggaaggaggag

SEQ ID NO: 4192791 - RNA, 58 nt, Human
cuccuccucuugcacugucccaggggucccuccaacccaggccuugaugaguggggag

SEQ ID NO: 4192792 - RNA, 84 nt, Human
cuccucggcccggguuccagcgggugccaguggcuguuuugcaaagucucagggccacccggggaaaagaggaagcucggggag

SEQ ID NO: 4192793 - RNA, 68 nt, Human
cuccucuggcuguguucagcaucaacggccucaugaucaaacagcugcaguacacggccuauggggag

SEQ ID NO: 4192794 - RNA, 74 nt, Human
cuccucuggguccugguggccaucaauugugcugcccauggaugcaagcauuaccacccauggauccagaggag

SEQ ID NO: 4192795 - RNA, 68 nt, Human
cuccugaaggccugaguuccaccaggaaagugagcuggcacuggggugggaauccaggccuucaucag

SEQ ID NO: 4192796 - RNA, 59 nt, Human
cuccugaccugugauccucucacccuggccucccaaagugcugugauuacaggcaugag

SEQ ID NO: 4192797 - RNA, 60 nt, Human
cuccugaccuugugauccgccugccuuggccucccaaagugcugggauuacaggcuugag

SEQ ID NO: 4192798 - RNA, 56 nt, Human
cuccugauguggugccuuuugggaauuaacccucuccccuaggaacgcagcaggag

SEQ ID NO: 4192799 - RNA, 80 nt, Human
cuccugcgucagguuccauaggaauccuuuccccgccaguggaggaggcucucccgucuuuuggaaaugaugugcaggag

SEQ ID NO: 4192800 - RNA, 64 nt, Human
cuccugcuucucaacuggcacucugacacacccucagaaagucagaguacugggagaacagaag

SEQ ID NO: 4192801 - RNA, 75 nt, Human
cuccuggagagaggccuggaagaugggggggucauucagagaccccaguuguuggggggaccugcuuuccaggag

SEQ ID NO: 4192802 - RNA, 55 nt, Human
cuccuggagggccaaagaaauaagaaccacuggucuaggccuauuauuccaggag

SEQ ID NO: 4192803 - RNA, 66 nt, Human
cuccuggaugcacggucaugucuuuucauccugcuuguacuugaacuugacuguagacccuuggag

SEQ ID NO: 4192804 - RNA, 55 nt, Human
cuccuggcacugucuugacccacagccuucucugggaugaggacuaagccagaag

SEQ ID NO: 4192805 - RNA, 58 nt, Human
cuccuggcaggcugagugaaauaaaggacuuguuauuucaucucgaggccuaccggag

SEQ ID NO: 4192806 - RNA, 109 nt, Human
cuccugggcaaucugagcugcuguacgcccugcucuggucucugcccgccaggcgagcgccgugcgcgagaggagcaggcaggggaagcacgcaggcggcauguaggag

SEQ ID NO: 4192807 - RNA, 69 nt, Human
cuccugggggcuccuuggcaguggcaggcuggggacagugccuggcaggcuggggacagugccugggag

SEQ ID NO: 4192808 - RNA, 63 nt, Human
cuccugguauuugcuuuuuguggucugggaugucccagacucaacagggaacaagaucagaag

SEQ ID NO: 4192809 - RNA, 81 nt, Human
cuccugugcacaacccccagggcugccgcaucccugguagcaucuccuuggcagcugggugggcuggcccugggcaaggag

SEQ ID NO: 4192810 - RNA, 64 nt, Human
cuccuguggcuuucugauuucacaggcaccauagguugagugcaugaugaguagguuacaggag

SEQ ID NO: 4192811 - RNA, 66 nt, Human
cuccuuaaugucuuaaagucguguuacaagaacaucuugcaguucguaguucagacagcuagggag

SEQ ID NO: 4192812 - RNA, 68 nt, Human
cuccuuagagauauuaagaugcuauugguuuucaauaucugaaagccaaugaguuuuaauuccuagag

SEQ ID NO: 4192813 - RNA, 63 nt, Human
cuccuucagcagaugcaaaaccccucgguaaaacugcaggauuagcgucucuguuggcgggag

SEQ ID NO: 4192814 - RNA, 55 nt, Human
cuccuucaugucauguguccggggaugguaaaaaaucaucauacacaugagggag

SEQ ID NO: 4192815 - RNA, 64 nt, Human
cuccuucauguuugaggcuuauucaguuuucucagaaguugaguuuuuucaacauaugaagaag

SEQ ID NO: 4192816 - RNA, 71 nt, Human
cuccuucauucauucauuaauucauucagugacuguuauguaguaggugcugagcuuuaaaggagaaggag

SEQ ID NO: 4192817 - RNA, 129 nt, Human
cuccuucccaagagagagaaagcaacgccaucgcuugcuguccucaggccugcaggcuuccuggaaaacauccuucuaaagucaugucccugaagugguggaagauauugagccuaucucucggggcug

SEQ ID NO: 4192818 - RNA, 67 nt, Human
cuccuucucuucuguucugcagcucauucaaaagagcccauagaaacacagagagacccaugaggag

SEQ ID NO: 4192819 - RNA, 69 nt, Human
cuccuugcaggcagggacacugucucauuuauuuuauagaccccgugcccagugcuuggcauauaggag

SEQ ID NO: 4192820 - RNA, 57 nt, Human
cuccuuggagcccaggaguagcaaaagguuaauugcuaggguguugggcccaagcag

SEQ ID NO: 4192821 - RNA, 109 nt, Human
cuccuuggcuaaggcauugaaugaaaucugcuggguaaagaguggaaggauaagaagcugaggagcacucuuuaccuacuucaggcuucuuuaguaaccuuuagaggag

SEQ ID NO: 4192822 - RNA, 130 nt, Human
cuccuugguuaaauucagugaguaauuucugacuguauucacugccgggggauauauuucuuuagaguuaaauaucacuggcugugcauuuugauaugagaaaugcgggcugcaauuuauaaccgacaag

SEQ ID NO: 4192823 - RNA, 82 nt, Human
cuccuuuaaauagagguuaagauucuguaaugcuugucuggcacauagcaaguauauacuaaauguuaaucauuugagggag

SEQ ID NO: 4192824 - RNA, 88 nt, Human
cuccuuucccagcuucagcuccucccaaguguauaggaugccaaguaauugccccacacuggcaugggauggaggaguuuuaaaggag

SEQ ID NO: 4192825 - RNA, 125 nt, Human
cuccuuucugagaagugguugaauguuugggguacagggugcuagaaguucugaaguuggucucagggagacgaaagagucuggcacuguaccagccaaggugcaaccaucuuuuggagagagag

SEQ ID NO: 4192826 - RNA, 75 nt, Human
cuguuucuucacugaccgucuucccacuuucuguccaagggacaggccagauggaagaggucaguggaggggcag

SEQ ID NO: 4192827 - RNA, 59 nt, Human
cuguuugacugaugugucaaguucaagauggaugcacaugaaguggucagaucaaacag

SEQ ID NO: 4192828 - RNA, 78 nt, Human
cuguuuucagggucaauaguuuaaacaagaagcuuaagagugaagcucuugaaauaauggcuaaugcucaggaaacag

SEQ ID NO: 4192829 - RNA, 70 nt, Human
cuguuuugguuucugcuucucagcuucugaaugucacccaccaagaagcugugagcuggaugcuccacag

SEQ ID NO: 4192830 - RNA, 69 nt, Human
cuguuuuuaaacacuggagcuggguguuccugugagagugagcugcuaucuccagauguuugcaagcag

SEQ ID NO: 4192831 - RNA, 69 nt, Human
cuguuuuuaaacuaugacauuugaagagcaguugaagaaaguaaagcugcucaugguggagaaaagcag

SEQ ID NO: 4192832 - RNA, 69 nt, Human
cuguuuuuaagguuucuaguuucuaaacuccaugcccugugcugaguuuagaagaggaacuuguuacag

SEQ ID NO: 4192833 - RNA, 81 nt, Human
cuguuuuuauccaguaccaugauguuugaguuacuauagcuuuguaguaucuuuugaaaucagguauugugaugccuccag

SEQ ID NO: 4192834 - RNA, 79 nt, Human
cuguuuuucacugaagccacuggaagaggagucuuaacauuccauauuucagaguuucagaaccccccgugaaaaccag

SEQ ID NO: 4192835 - RNA, 55 nt, Human
cuguuuuugcaaagagaguuucaagagugcauuguaacauuguuuguaaaagcag

SEQ ID NO: 4192836 - RNA, 77 nt, Human
cuuaaacagagguaaggaagagccugguaaacacugugcucucuuuacauuguuuuuucuugccaucuguuuuuaag

SEQ ID NO: 4192837 - RNA, 112 nt, Human
cuuaaagaauagaccaagagcagccaguguuguuuagaagcaccuauuggcuggauugagaagcuauuaauuuaauccaaguguuacauuggcuagaaguucuuucuuuaag

SEQ ID NO: 4192838 - RNA, 62 nt, Human
cuuaaagcacuaaaugaugaggggguggugacagugguaaccuuuaugauagaugcuuucag

SEQ ID NO: 4192839 - RNA, 102 nt, Human
cuuaaaguuacuaaagggcgucuaaguaugcaaaucgucuuagaaugcaggguaauggucauuugaagacauuugaauacuuucauccacugugacucugag

SEQ ID NO: 4192840 - RNA, 80 nt, Human
cuuaaauagcaaaauguagacauauggugaaacauuuuaaccacuucugguugaaacucaguaugguuuagcuaaaugag

SEQ ID NO: 4192841 - RNA, 67 nt, Human
cucuacucuucugcgcugcccugggagccacgaggugcugcugggccuagcaacagaggagucagag

SEQ ID NO: 4192842 - RNA, 83 nt, Human
cucuagaacagggacaaugagaaccuugaaaggaacuuugcaaguucuauaaguuugucauuuuaauucuccucagcuuggag

SEQ ID NO: 4192843 - RNA, 61 nt, Human
cucuagaggcuugaaugggcgaggaagcuauaaugacuccauguuccuucuugccucagag

SEQ ID NO: 4192844 - RNA, 59 nt, Human
cucuagcucugugcucuggaucuguugguauuccaaugauucaacacuuggaguaagag

SEQ ID NO: 4192845 - RNA, 69 nt, Human
cucuagcugaggucacugcuaugccuagaaauagcugaacaggcagcucaguuaucccucggacuggag

SEQ ID NO: 4192846 - RNA, 69 nt, Human
cucuaggggcuggucagcgucucuagggaauuaugggggaaauagauaugcaaacgacggcaccuggag

SEQ ID NO: 4192847 - RNA, 87 nt, Human
cucuaguaguacuuguuggugaugccacacauauuuuacuuugaagaagccagauaauguuuauacaccugcaggaacuagcuagag

SEQ ID NO: 4192848 - RNA, 60 nt, Human
cucuaucauucuucucaccuuugaacuugcauaauuucaauggucuuugaggaguuagag

SEQ ID NO: 4192849 - RNA, 77 nt, Human
cucuaugcccuggauuucauagacugccaucuaauccaguuaggagaggaaguagaaguaaugaaaucaagggagag

SEQ ID NO: 4192850 - RNA, 59 nt, Human
cucuauguggauggucugauuccaaagcccaaaugagcuaauuuuacuguccuauagag

SEQ ID NO: 4192851 - RNA, 64 nt, Human
cucuauuuccucaugaucauaaugcagcaggaaaacuuugcaucauaauuuugagagaggagag

SEQ ID NO: 4192852 - RNA, 84 nt, Human
cucucaaucaucagucuagucuugcuccuuauccugcucugaggaacagagaggccaguguggcuggagcacagugagugagag

SEQ ID NO: 4192853 - RNA, 57 nt, Human
cucucaauucacggcaaggucugcaggagaacacauagacucuguuguacuugaggg

SEQ ID NO: 4192854 - RNA, 127 nt, Human
cucucacagaggguaaaaccacagaacccaugagacucccuuuaagacuuuucaaaggcaaacauucccaauggcaaacuggaaagcuugaguuuagagauggguuuuuggaagaccaaauaugagg

SEQ ID NO: 4192855 - RNA, 59 nt, Human
cucucacagccauugcaguacauugaucuccauagagacagugccagggcaggugagag

SEQ ID NO: 4192856 - RNA, 58 nt, Human
cucucacauuucuuuuaagaggugcuuugccaugagaguauuuccaagaauuggagag

SEQ ID NO: 4192857 - RNA, 80 nt, Human
cucucagaagagcauuugcccaggcuguaggacguuucccgaucagugcagccccagggaagaugugugcuuacuggggg

SEQ ID NO: 4192858 - RNA, 72 nt, Human
cucucagcacugucugcuggcucccuucucucucuguugaggaauaaagggagcggggagacccuaugggag

SEQ ID NO: 4192859 - RNA, 73 nt, Human
cucucaguccugcgcgccucugugggccaagacacacccacagaaaugcagcaugaggcggcaggccugaggg

SEQ ID NO: 4192860 - RNA, 68 nt, Human
cucucagugccacacagccauuccugccucucaucaagcagguuaugaugggcacggcagucugagag

SEQ ID NO: 4192861 - RNA, 66 nt, Human
cucucagugcuugguaguuugauacauaagucaaugaguauugcagacaaaaugagcuacuguggg

SEQ ID NO: 4192862 - RNA, 64 nt, Human
cucucauuccuguuuguuguuuagccgguauaugcaaggcuguaaagaacauuaggaaucagag

SEQ ID NO: 4192863 - RNA, 74 nt, Human
cucucccacuuuuuugguagugccuucugccauucuuuguaaccgagaaggucaaggccaaaagagugguggag

SEQ ID NO: 4192864 - RNA, 59 nt, Human
cucucccccaucacauuuaaggggaaggaccacaggcccaccucucauugugaggagag

SEQ ID NO: 4192865 - RNA, 63 nt, Human
cucucccugguggccuucagcccacaacugcaaggcgguugugguguugggugccagcgagag

SEQ ID NO: 4192866 - RNA, 57 nt, Human
cucuccggcagcugacauuuggggccacuaaagucccagcuuucccacugccgagag

SEQ ID NO: 4192867 - RNA, 59 nt, Human
cucuccuaguccccaagugugagucuaaacugccacucaugcauggauuucagugagag

SEQ ID NO: 4192868 - RNA, 82 nt, Human
cucuccuauguccaaggaaauacuucugcagagcacguuagaguuuccaaugcauguguguuaucucagagacaaagggcag

SEQ ID NO: 4192869 - RNA, 65 nt, Human
cucuccucuuggcuuugugccuucuuucagcuuagcugcaaagcagggaugaggcuagaggggag

SEQ ID NO: 4192870 - RNA, 66 nt, Human
cucuccugcucuuggaucacuuucucuguuugaaagaaucccugugacgagcaucccuauggagag

SEQ ID NO: 4192871 - RNA, 62 nt, Human
cucuccuggcucugggccuucugcgccuuuguucaagggcuucggcauccacagcuggagag

SEQ ID NO: 4192872 - RNA, 129 nt, Human
cucuccugucacuguagaaauugauuuccuauguggauuuguggaagcccuaugagagacaguuuucuuaugacugugcugucaauugcuuucaguaaguaucuguaaugauaggcuauaaugggagag

SEQ ID NO: 4192873 - RNA, 74 nt, Human
cucuccugugucaggcacuaguaagaaaaaggcacaacgcuuuuuccucguagagccuaaugucuagaggggag

SEQ ID NO: 4192874 - RNA, 129 nt, Human
cucuccuuaauuaauuguaacuauagugucuuauguggaaaaugcacuuaaaacccucuuuucuccaaacaaaaugguguuaaaacugcaaauccuacugaaacauguuacagaaaauuggcaguaggg

SEQ ID NO: 4192875 - RNA, 56 nt, Human
cucuccuuugaagcaacuguauucuaaguucuaaauauaguugcuucaaaggagag

SEQ ID NO: 4192876 - RNA, 59 nt, Human
cucucggccaccauugccguucucagagcugcugaggagggguucucgggugcugaggg

SEQ ID NO: 4192877 - RNA, 60 nt, Human
cucucuauggaugcaguuuuucucuccauucuacaaaugaggaaacugaagcccagagag

SEQ ID NO: 4192878 - RNA, 61 nt, Human
cucucucucugcugucugaagacacagcaagaaggugucugucugcaagccagaaagagag

SEQ ID NO: 4192879 - RNA, 60 nt, Human
cucucucugguacauagaguuugguccagggaccaagcucuauaccagagaaacccugag

SEQ ID NO: 4192880 - RNA, 61 nt, Human
cucucugaugccaucagacagucauucaucacauucugccgauugucagccuucagaggag

SEQ ID NO: 4192881 - RNA, 76 nt, Human
cucucuggacagggcaggggccacccuuguuggccuugacuucauagugccuacaguguccccagcucugugagag

SEQ ID NO: 4192882 - RNA, 61 nt, Human
cucucugggaauauuuuauucugauccaguagcagggaggaaaaggauguuaucccaggag

SEQ ID NO: 4192883 - RNA, 58 nt, Human
cucucugggguuccagacgugggugcugcugugcgcacucucucccuacuccggaggg

SEQ ID NO: 4192884 - RNA, 66 nt, Human
cucucuggguggccccugagacuccuccagugucccuggcugggagcagcacugccacacagaggg

SEQ ID NO: 4192885 - RNA, 67 nt, Human
cucucuucccuaacagguccacaguggucaaaacucuaaacauaugaacacuuauuggggaagguag

SEQ ID NO: 4192886 - RNA, 74 nt, Human
cucucuugggcauggccucaaaggacugcagaauagaacaccuaucugguagaagaagugaagcuggcagagag

SEQ ID NO: 4192887 - RNA, 56 nt, Human
cucucuuucugaaugaggacuaaaggaaacccuuucagugagucuagagaagagag

SEQ ID NO: 4192888 - RNA, 58 nt, Human
cucugaaaaugugguggggaaagggaaauccugagucugaauuaucucauuuucagag

SEQ ID NO: 4192889 - RNA, 101 nt, Human
cucugaacacauggcccguuuuuauauauauguagaggucacgaugauucauuucuaagcauucauuuuuauauauguguaguuuuuauauguguguagag

SEQ ID NO: 4192890 - RNA, 105 nt, Human
cucugaacacuuaggaugauggugcuggugggggcaggaagguagcacagugcugaugguggccagucugcucccacaaguucccagucaccaaggcuggcaggg

SEQ ID NO: 4192891 - RNA, 82 nt, Human
cucugacuguuugaaaguggcaaguccuugcuugaagacucacucauuaccuuuagcucaagggaccacauucaaacaagag

SEQ ID NO: 4192892 - RNA, 59 nt, Human
cucugagaaagcugugagcuaaaaguugccuuacauugcagaacucucaguuuccagag

SEQ ID NO: 4192893 - RNA, 64 nt, Human
cucugagacucaagugaguggggcugaagcagaugaggguggcccccuuucugggucucuggag

SEQ ID NO: 4192894 - RNA, 76 nt, Human
cucugagcagcacugaguuagcagcuccagccagacuagaagaagggaagcaggucaacugagagcugacacagag

SEQ ID NO: 4192895 - RNA, 99 nt, Human
cucugagccucaguuuccuaggcuguaaaaugaaccuagucaucccuugguuguaggaaugaugaguagggauauuuuguggcgaggcugggcccagag

SEQ ID NO: 4192896 - RNA, 96 nt, Human
cucugaggcucauaguuuaguuaguaugauuguaucaauguuaauuuccugguuuugacaauugugcuaugauuaugaaagaugcuaacauuagag

SEQ ID NO: 4192897 - RNA, 65 nt, Human
cucugaguguaggcacgaagcuuucagcucugaaacuucaccuuuuugccacacuagcagcagag

SEQ ID NO: 4192898 - RNA, 67 nt, Human
cucugauguauugucaggcuauguccaaauuuuuaauuuggaaacuauagucacaauagauacaggg

SEQ ID NO: 4192899 - RNA, 107 nt, Human
cucugcaaaugggguucggggagugacuuuucucuggcaggaaggguacaaguggcuuuucuaagggaaacguccuccuccacucuugcaaaacuccaugaacagag

SEQ ID NO: 4192900 - RNA, 109 nt, Human
cucugcaaguaggagaaaagagguaggagguagguauugugugagaacugggugucucuauuuucaauccaguauuuccucugaaaccccucugcuucuuacuucagag

SEQ ID NO: 4192901 - RNA, 79 nt, Human
cuuccagggagucaacaaacagaucaacuaaggacaauuuacagaugauuuguuuucugcacucuccucuccugguaag

SEQ ID NO: 4192902 - RNA, 57 nt, Human
cuuccaggguccaggaagagcccgugucuaggcuuuuugacuccuggccuuuggaag

SEQ ID NO: 4192903 - RNA, 58 nt, Human
cuuccaguccauaugccauaauucuuucaaacucugggaagaaugcugugguuggaag

SEQ ID NO: 4192904 - RNA, 127 nt, Human
cuuccaucuuucauuaugggcaugcuuaccucccuguuaucuccaugacaaguugguuaggccaaggccuggcuagcccuuguggggagaggaugagauaagcauuaaauaggagauuagauugaag

SEQ ID NO: 4192905 - RNA, 68 nt, Human
cuuccaugccaggcccgugcacagcccccaaagcagcuccaucugggcugugcagccugcggcaaaag

SEQ ID NO: 4192906 - RNA, 110 nt, Human
cuuccauuccaaccugagucacugcccacuccuucguccaacgucaguuuccucaacuguguauugggagguugaggugggugugcgggacgugaguugguccuuugaag

SEQ ID NO: 4192907 - RNA, 58 nt, Human
cuuccauuuacacuccuuggggacucuucuuugagggacucugaggcugagaagggag

SEQ ID NO: 4192908 - RNA, 59 nt, Human
cuucccaagcuccgggcuucugaagacuugccucaggggcuccaaggaaguuugggagg

SEQ ID NO: 4192909 - RNA, 82 nt, Human
cuucccagccucucagcucaaacucaggugugaagguuuaugaugcagucacagcuuugagcagagaccacaggcaggggag

SEQ ID NO: 4192910 - RNA, 65 nt, Human
cuucccagcuccccacgccuggacuaagagguccauccuuggggcugaggcugggggcagggugg

SEQ ID NO: 4192911 - RNA, 80 nt, Human
cuucccaucucuccugcuggaagagauuggagccuccuuugggggcucuggcuuugccagcccuagcggggagugggagg

SEQ ID NO: 4192912 - RNA, 103 nt, Human
cuuccccaauagauaugcucucucgguuuccuaauugucuagaggcuuugauuuaucuggcagaggaaggaggccugagauaucugggcaaaguucugggaag

SEQ ID NO: 4192913 - RNA, 77 nt, Human
cuucccggccuggcucccgaagcccucagugucccuauugauuccuaggccgcugcagaugggagcugguugugagg

SEQ ID NO: 4192914 - RNA, 78 nt, Human
cuucccuaaaugccccuucuggucuucaauggugaacacgcuucacuaaugaaaaccagaagagacauucuggugaag

SEQ ID NO: 4192915 - RNA, 128 nt, Human
cuucccuacacaucccguuggccagaacagucaacagccauauguagcugccagagaguugcacacgucauuuugauucugggcagccaugugccuggcuaacguuugggcuucuggaaggguagaag

SEQ ID NO: 4192916 - RNA, 57 nt, Human
cuucccucacagugaguggguucccugaugcgagaggcccuacuuguuugagggaag

SEQ ID NO: 4192917 - RNA, 101 nt, Human
cuucccuccccggcggaggccccugcggacugccuagagcugggucgcaacugaggcguuauccgcgggccuggccucgggaaguggcggggaggaagaag

SEQ ID NO: 4192918 - RNA, 64 nt, Human
cuucccucuccaggagcccugagcucugguucagguaguuuaacuguuccacuggagagagaag

SEQ ID NO: 4192919 - RNA, 73 nt, Human
cuucccuuacaaacaagaucuuauucuuuaagugcguacugaugccaagaaagagauuaguuuggugggggag

SEQ ID NO: 4192920 - RNA, 70 nt, Human
cuuccgggcucugugacucgcuguugcagcugacuggcuguaacagugugaggucucaggcgcuuggagg

SEQ ID NO: 4192921 - RNA, 57 nt, Human
cuuccgucuuaagcagccaacgagcagccacgcagcgugcugcuagcgggacgggag

SEQ ID NO: 4192922 - RNA, 70 nt, Human
cuuccuacaggugaaguauuacacuaaggguuuuauauaaaaucucauugauccuuauacuuuacggaag

SEQ ID NO: 4192923 - RNA, 55 nt, Human
cuuccuagcuucagagucuguuuuguccuaacuuucucugacucagaguuggaag

SEQ ID NO: 4192924 - RNA, 87 nt, Human
cuuccuagucucuaauacugaccaagucaccacacccucuuggaauguuuacuggggcugagugaguggaaagugagggaugggagg

SEQ ID NO: 4192925 - RNA, 83 nt, Human
cuuccucagaugucacugcagccccaagcggguuccccugucaaauuccugaccgguccuuggggacgcugacaucgugggag

SEQ ID NO: 4192926 - RNA, 57 nt, Human
cuuccucccccacacacucacugaacgugugccaggcacugugugggggaaggacag

SEQ ID NO: 4192927 - RNA, 56 nt, Human
cuuccuccgaagaaguugcuggcaggaccaaggccagggcuuggaagagagagaag

SEQ ID NO: 4192928 - RNA, 59 nt, Human
cuuccucucuaagaaacucucagccuaggcagguccccaguuuuccauuagggagggag

SEQ ID NO: 4192929 - RNA, 112 nt, Human
cuuccucucuccuuuccugucauucugugugccagaguugugcugucuacacagcaagcuccuaagcaaugguggugaucaggcuauguauacucccgaagaaauggggaag

SEQ ID NO: 4192930 - RNA, 61 nt, Human
cuuccucuguggccagaguguaggucagcucagcaaacagcauuguggccuacagggcaag

SEQ ID NO: 4192931 - RNA, 129 nt, Human
cuuccucuuauaaggacccuugugauuauauggagccuuucuagauaauccaggauaaucugcccaucucaaauccuuaaugaugucugaaaagucaaaguaacguaugacaggguccaugggauuagg

SEQ ID NO: 4192932 - RNA, 86 nt, Human
cugacagcugcuuguccugagggagaaauaaaggaaacuggugaaacacaugcuauuuccaugaauucccacucaugugcuguuag

SEQ ID NO: 4192933 - RNA, 82 nt, Human
cugacaguucucaacagccagucccauccuccuaaagaucuccagaaucagccacauggaccugaugcuagaggccugucag

SEQ ID NO: 4192934 - RNA, 79 nt, Human
cugacauaaauuuucauaaacaaauuaaggccugguccaaaaaauucaaauuucauuuuuucaggcugauuuguguuag

SEQ ID NO: 4192935 - RNA, 68 nt, Human
cugaccaaggaggcccucuccuucuggaaucugggguuccaguuagucuagaugggucucuuggacag

SEQ ID NO: 4192936 - RNA, 80 nt, Human
cugaccaaguuucuucagaagaaaagcagugugugugcuucuguuccuguaagcacacugcccuuuggagguuuggucag

SEQ ID NO: 4192937 - RNA, 67 nt, Human
cugaccacaugcguccuaggccccagcagcucugaacugcuuccugggacaggcuaugugcugucag

SEQ ID NO: 4192938 - RNA, 66 nt, Human
cugacccugccuguccuggucccguuuagcaaaugcucuaauccucuuaggccaggccagccucag

SEQ ID NO: 4192939 - RNA, 61 nt, Human
cugacccugucuucccccauucugauuuaauaaagaauuuggagagggugaguagugucag

SEQ ID NO: 4192940 - RNA, 57 nt, Human
cugaccugcaccuucucuggguucucacucagcacuucuggaauggguguggguuag

SEQ ID NO: 4192941 - RNA, 61 nt, Human
cugaccuguagcuuccaagaccaggggccuggugcccugguaggagggaaaugcggguugg

SEQ ID NO: 4192942 - RNA, 63 nt, Human
cugaccuuggagcggccugggucuggugcacgugcacggcaggcccaucugcucccaggcugg

SEQ ID NO: 4192943 - RNA, 116 nt, Human
cugaccuugugauccacccgccucggccucccaaagugcuaggauuacaggccugagccaccgcgcccggccuaauuuuuguauuuuuuuguagagacaggguuucacuacguuag

SEQ ID NO: 4192944 - RNA, 57 nt, Human
cugaccuugugaucugcccaccuuggacucccaaagugcugaaauuacaggugugag

SEQ ID NO: 4192945 - RNA, 74 nt, Human
cugacggcuucaaggcagcuccgcaaucaaucaauaucuucuuuugauugcauggaguaauugaugcuuguuag

SEQ ID NO: 4192946 - RNA, 56 nt, Human
cugacuacaaaaaagcuagucuuuuccaugcgauguagaggcuuucuuguagucag

SEQ ID NO: 4192947 - RNA, 118 nt, Human
cugacuaccccuucucugaaaugcuugggaccagaaguguuuuggauuuuggaauauuugcauuauauuccaaaacccaaaaugcuccaaugagcauuuccuuugagugucacgucag

SEQ ID NO: 4192948 - RNA, 71 nt, Human
cugacuagcaaguuuaaaaucauuuggaaaccagguuugugauccaagggaauuuaaaguugcugacacag

SEQ ID NO: 4192949 - RNA, 56 nt, Human
cugacucugacaggacuuguggagaaaaagucuaccgauuucuguuuucagggcag

SEQ ID NO: 4192950 - RNA, 58 nt, Human
cugacucuguuugcagguagcucagguggccagagaagguccucaggcagagacacag

SEQ ID NO: 4192951 - RNA, 75 nt, Human
cugacugauuuccaggauucuaaucuucacugucuaagcuguggguuuccaauccuggaugcugguuacagucag

SEQ ID NO: 4192952 - RNA, 60 nt, Human
cugacugcucuuugcucuacauuaucuuuuucaggguguuuauacagcaaagagcauuag

SEQ ID NO: 4192953 - RNA, 58 nt, Human
cugacuggaagcuguacaguucaccuagaagacaggcugggcuuacucuuucagugag

SEQ ID NO: 4192954 - RNA, 60 nt, Human
cugacugggcccuauggaagaaaggggucaagccccuuauaaguucugaggacccaacag

SEQ ID NO: 4192955 - RNA, 101 nt, Human
cugacuguggcuucuuuacauugaagugucuggccuccuccucuacaaccaagaugauggggaguugucagggguucaaccagagaagcagaaucagucgg

SEQ ID NO: 4192956 - RNA, 60 nt, Human
cugacugugucaaggaggguguggcccccacgucugggccuccccucuccugcuaguggg

SEQ ID NO: 4192957 - RNA, 114 nt, Human
cugacuugcagaaagguauggacaugaggcaauagaauauugaauuccuaagaacaagagaggagggaagucagugaaggcauugcucaaucuauacaaucaaaagaaaguuag

SEQ ID NO: 4192958 - RNA, 65 nt, Human
cugagaaacuguuggaauuuuaauguggcuaaggugaccauaaugaguuuccuccagauucacag

SEQ ID NO: 4192959 - RNA, 80 nt, Human
cugagaagcagccacggggagacagaagcaccaccagaaagagccuuccaugucacucucacccgcgggcaugugcucag

SEQ ID NO: 4192960 - RNA, 128 nt, Human
cugagacggagaaagugguguggcagaagagguugcugguggccaugggucggggugcagauuaugagagaacucuggccagugacugcucacccggggcagcguugaguccaucaacaccguuuugg

SEQ ID NO: 4192961 - RNA, 68 nt, Human
cugagagaaacaugacucaggaggauuuguucaaaccccuaguuccucaugaacaugcuuauccucag

SEQ ID NO: 4192962 - RNA, 102 nt, Human
cugagagaggagaauugcuuaaacccggagucggagguugcagugagccaagaucgcaccauugcacuccagccugggcgacagagcaagacucugucucag

SEQ ID NO: 4192963 - RNA, 60 nt, Human
cugagagaggccuccauguacugaaguucccugccuucagagucaggggccuuuauucag

SEQ ID NO: 4192964 - RNA, 59 nt, Human
cugagagcaggaccaggucuaaugaagacacuggugacaugugccuggcuugcuuucgg

SEQ ID NO: 4192965 - RNA, 61 nt, Human
cugagagcauacauauagcuacgugacuuuggucgaagagcuucaucuugcugugucucag

SEQ ID NO: 4192966 - RNA, 81 nt, Human
cugagagcuggaccuucucuuucacccguucgacgcagcaaguucuuaccuugccugggguggauggguccaaguuuucgg

SEQ ID NO: 4192967 - RNA, 130 nt, Human
cugagaucuuacuaccagccccuuaaagucauucugacucuguuuuagggauuuguccugggccccugguugauaaagucccugagacucuggaguguaaucagacuugauuuuuuccccauccucucag

SEQ ID NO: 4192968 - RNA, 56 nt, Human
cugagaucuuuauacgaggcacugagaacagugccuuguccuucgucagggcucag

SEQ ID NO: 4192969 - RNA, 103 nt, Human
cugagauggaguuuugcucuuuugccuaggcuggaguguaguggugugaucuucgcucacugcaaccucugccuucugguuucaagcgauucuccugccucag

SEQ ID NO: 4192970 - RNA, 65 nt, Human
cugagauuaagauauugggaguugaugguuucuauacauuuuacuuaaaugguucuuuaucucag

SEQ ID NO: 4192971 - RNA, 71 nt, Human
cugagcacagcuuucacuagaaaggagcaagcuaaucaaugauggcaagccuuucagugguuugugccuag

SEQ ID NO: 4192972 - RNA, 72 nt, Human
cugagcacccgacagugccugucauaugguaggcacuuagcgaauauuuggaggccacuguugagugaaugg

SEQ ID NO: 4192973 - RNA, 98 nt, Human
cugagcagauguagccacaugcuacagugaaggaggaagccccggcuuugcauuggucucuucuuccuucaugguagcauguggcugcaucuguucag

SEQ ID NO: 4192974 - RNA, 68 nt, Human
cuuccucccuuccaaugacuaugcuucagauucuuuccuggucaucguuuuaauggaaggagagaaag

SEQ ID NO: 4192975 - RNA, 65 nt, Human
cuuccuccgucugccccucaccccagcacauguuaggacagugaggagcugacacuggggugaag

SEQ ID NO: 4192976 - RNA, 83 nt, Human
cuuccugcccccagagagcaccaugaagcccaaugaagguggauauggggcaggagcucgcuggggcucuggugugcaggaag

SEQ ID NO: 4192977 - RNA, 80 nt, Human
cuuccugccucuuucuuuguccaccaacaauggacuggucuaccugucuauagcuuugcugagaaaaagagaacuggaag

SEQ ID NO: 4192978 - RNA, 58 nt, Human
cuuccugccuucuuaucuguuuuaggugaaaguggagaaacagugaggagauuggaag

SEQ ID NO: 4192979 - RNA, 122 nt, Human
cuuccuguaacagaccuagagaaccagccucauuacagccaggaagcauauaaugaacuugugcugcauauaugguccugagugaggcauagugggagcccucaggucaaucagacacagag

SEQ ID NO: 4192980 - RNA, 81 nt, Human
cuuccugucccaugugguccccagaggaauaugagauugccacaaacauggcagcuuucuuuggggaggugggagagggag

SEQ ID NO: 4192981 - RNA, 67 nt, Human
cuuccuguugugugugucucauccuguuucaugauggcuccaugaggcacaucacagccaauggcag

SEQ ID NO: 4192982 - RNA, 61 nt, Human
cuuccuguuuuuguaaucgacucugcucaccuucuagagagugcauuccagacaugggagg

SEQ ID NO: 4192983 - RNA, 81 nt, Human
cuuccuuaaagugaguuuggguucauugugaugcaaagauauacuguaaucauggccucaaauuuuauaacacaaaggaag

SEQ ID NO: 4192984 - RNA, 58 nt, Human
cuugaccuugugauccgcccacuuuggccucccaaagugcugggauuacaagcaugag

SEQ ID NO: 4192985 - RNA, 69 nt, Human
cuugacuacugcuguuuauagggaggcccuuggggcagguuuguccucuguguaggcugcagacuugag

SEQ ID NO: 4192986 - RNA, 75 nt, Human
cuugacucugaaauucuuuugugcggugaagucaagaaccugaacuggccagccaacaacaauagcagcgucagg

SEQ ID NO: 4192987 - RNA, 55 nt, Human
cuugacugccaaugugacuguauuuggagacagguccuuuacagagguaauuaag

SEQ ID NO: 4192988 - RNA, 58 nt, Human
cuugacuuagaaauucaguuuugucacauacuagcugugugauauucuccuagucagg

SEQ ID NO: 4192989 - RNA, 56 nt, Human
cuugagaaaggaacaggaagcuuguuuacaaaugaacaaauuccugcuuuuguaag

SEQ ID NO: 4192990 - RNA, 79 nt, Human
cuugagacauaauguugagcuugaaaguagguuuaguuuuuugaauacacaguucuugguuuaauaguuaagugucagg

SEQ ID NO: 4192991 - RNA, 61 nt, Human
cuugagaggcuggcugcugugcucacaagccuucauuuacacagcaagccuuccuuucagg

SEQ ID NO: 4192992 - RNA, 70 nt, Human
cuugagcccaggagguggagcuuucagugagccaugauuaagucacugcacuccauccugggcaacagag

SEQ ID NO: 4192993 - RNA, 94 nt, Human
cuugagggcuuugaugaucaggucagaggcagaaggcaccaccucaaucugggccugucuguucugacuggucaguuucacuguaauccucagg

SEQ ID NO: 4192994 - RNA, 93 nt, Human
cuugagucuuucauucauuucucuguauucagugccuagcauaugccaggcucucgugugggcacuggauaauauaaaaaugaaggacuuggg

SEQ ID NO: 4192995 - RNA, 67 nt, Human
cuugagugugaguguaugugugugcgugugcgugugcgugugcgugugcgugugcauggccuucggg

SEQ ID NO: 4192996 - RNA, 61 nt, Human
cuugauaucugcuugaauuucuugacuacucaccuugagaaguucuguucagccagacaag

SEQ ID NO: 4192997 - RNA, 69 nt, Human
cuugaugaaaugucaaagacaccaucuauucuggaaagaaaguagauuucucauggcgaaaauaucaag

SEQ ID NO: 4192998 - RNA, 68 nt, Human
cuugaugaugacgucggugauggcaucaaacacgaacuacguucuugguaucgguggcgcaugugaag

SEQ ID NO: 4192999 - RNA, 91 nt, Human
cuugaugcuagaugacagcgaaaaaauauuuaccaaguucagagggaaagacuugugacuuuagaauuuuauccagauuaucaguaugaag

SEQ ID NO: 4193000 - RNA, 69 nt, Human
cuugauuauuuuuaacugguuagacacaugcaugucaugugacuacaugauaaacaugucuaccucagg

SEQ ID NO: 4193001 - RNA, 67 nt, Human
cuugcaaucugagucacugcauuuuaacuguuuauuaaguggugacagugacagcuagauaguuuag

SEQ ID NO: 4193002 - RNA, 58 nt, Human
cuugcacagacucaccuuaauuugacauugucauauugauugugagucuguggccaag

SEQ ID NO: 4193003 - RNA, 72 nt, Human
cuugcacccauugcccucagcgcuuccagaucuuuuagaggaagggaaggcuggaaggcaaguaggaaagag

SEQ ID NO: 4193004 - RNA, 74 nt, Human
cuugcacccucacccaggcuggaaugcaauggcgcgaucucggcucacugcaaccuccgccucguagguucaag

SEQ ID NO: 4193005 - RNA, 87 nt, Human
cuugcacugaauggacagagaucaaaaguuuguuagguaaaaaauauuuaggccaaaugacuugauguuugaaaaauacauugcagg

SEQ ID NO: 4193006 - RNA, 58 nt, Human
cuugcagacagaaguauauaguguggaaaaugaaccaccucuuuugacucuuugcaag

SEQ ID NO: 4193007 - RNA, 77 nt, Human
cuugcagcuggaugaggaagucaggcauacaagccauaguaaugauauguagcagugucuaccacauuaauuguaag

SEQ ID NO: 4193008 - RNA, 67 nt, Human
cuugcaguaauagucccacuuuacaacucaagggggccaaacuguaaaguggcgcuguuacugccag

SEQ ID NO: 4193009 - RNA, 89 nt, Human
cuugccacccugugcucugcuuggccuauucugggugguuccaggagugaaaugaggcccaggcaaagcuguccagucagggagguaag

SEQ ID NO: 4193010 - RNA, 70 nt, Human
cuugccauggccgccgcugcucaggaaagaacuuuccuuagugcuccugcagcagagggcgggcagcaag

SEQ ID NO: 4193011 - RNA, 62 nt, Human
cuugcccugaccccauucccugugaaaguuucagaggaccagaggcacuggggauagguaag

SEQ ID NO: 4193012 - RNA, 87 nt, Human
cuugccuaaauuucccaaaggcuuuuaacuacuguuuuauaguggcuuuaaagcuuaauaguaaagaguaggagaguuuaugguagg

SEQ ID NO: 4193013 - RNA, 80 nt, Human
cuugccugguaccuucucuagaucuuuauucuaaacaaucgguuaguaaugauaaauucuguaggagggucuauuccgag

SEQ ID NO: 4193014 - RNA, 60 nt, Human
cuugccuuccccuugauaaugcaguaagggacccccuuuuuacaacauggggcaggcagg

SEQ ID NO: 4193015 - RNA, 79 nt, Human
cuugccuucggaaguuucugggcaagacaaggccaagggcacuuccaagugucccagagaucauucauccagaggcagg

SEQ ID NO: 4193016 - RNA, 58 nt, Human
cuugccuuggguccgcagugagcuauguacaucugcgucuguguagugcucagguaag

SEQ ID NO: 4193017 - RNA, 94 nt, Human
cuugccuuugaggugcucacaugcuguguguggagaucggcgcacaagccauugauuaccaaacaguauagugggccaggucgugggaggcgag

SEQ ID NO: 4193018 - RNA, 58 nt, Human
cuugcgaaugaccucacugcuuuuuguauuuguaauggaaugcacagucauuuguaag

SEQ ID NO: 4193019 - RNA, 76 nt, Human
cuugcguguguguaccugcgcauuuauugagcuuucaguccgcucuggaugucuguuggcaggagcacuuaucgag

SEQ ID NO: 4193020 - RNA, 89 nt, Human
cuugcuagaaauacaaauuguugggucucauucccgaucuacugaaacagagacuggguuugagacuuagcaaucuguguuucaacaag

SEQ ID NO: 4193021 - RNA, 82 nt, Human
cuugcucgaaacaaccaaauguuuuacuggcaucugggagugaagccaaugaacacauguggucaguuucuuuaugaguagg

SEQ ID NO: 4193022 - RNA, 126 nt, Human
cuugcucuacucaagcccaaaaagagaggaucuccugaagccauguaagauccaucauguggaagucugacuacuaugcugggaagacaagguggagaugcccugaggcuacaugaaaagaggaag

SEQ ID NO: 4193023 - RNA, 78 nt, Human
cuugcuggaggcuugaauggcacaggcagcccuuccugcagaaucuauugcugcuuggcuuucugagcuucuggcagg

SEQ ID NO: 4193024 - RNA, 92 nt, Human
cuugcuggcucaugaugaaguggcauggggguccccaguugcugggucccacacaggcccucugcucacuuccuauucuggagaucaaugag

SEQ ID NO: 4193025 - RNA, 107 nt, Human
cuugcuuccuuggauuuguggcucccaauaaggcaucagcacuuaacccuugacucaggcucugcuuuuuagggagccuaggcaaaagcaaauccaacacaagcaag

SEQ ID NO: 4193026 - RNA, 56 nt, Human
cuugcuuggagaagagaucaguaaaguaucugguuaugcucuguccacaggacaag

SEQ ID NO: 4193027 - RNA, 57 nt, Human
cuugcuuguccaguguagcaggcccagacauuuugacacaaagacuggaaaagcaag

SEQ ID NO: 4193028 - RNA, 63 nt, Human
cuugcuuuguccagaaauucagcuauaacuccacacaucugauggcccuuucuggcaagcagg

SEQ ID NO: 4193029 - RNA, 98 nt, Human
cuuggaaugaccuaaauucccaccuucucucuuuugucaguauaaauuaaaaauaagagagagcaggugguuaacauaauggaauuugcuucaccagg

SEQ ID NO: 4193030 - RNA, 78 nt, Human
cuuggagaauuuaagcaugccaucuguuuggaugaagaugcaaauaaucgcaaacauugggggcuucaacacucuagg

SEQ ID NO: 4193031 - RNA, 87 nt, Human
cuuggagauucugaucccguggcucuggaguggagugcuccccuaccagggaacagggauauuaauaagcgccucagagacaccaag

SEQ ID NO: 4193032 - RNA, 55 nt, Human
cuuggaguaaacgagcugguacccaacuuucaguucccagcagguucauuucagg

SEQ ID NO: 4193033 - RNA, 80 nt, Human
cuuggauuaggaggucauggacaaggugugagccauggauggaacuuggagggcaugcuguccaugggcugggguccagg

SEQ ID NO: 4193034 - RNA, 69 nt, Human
cuuggcaacacuuucaauucccuuagcaacucaaggugcaugagucacuaggcugaaaguggagcucag

SEQ ID NO: 4193035 - RNA, 66 nt, Human
cuuggcaagagauggcccaggggucugugcccaagaccccggucuccugggcuuuggcuuguuggg

SEQ ID NO: 4193036 - RNA, 57 nt, Human
cuuggcaucauguagugggcucuuacugagccauuuuucacacccaugcuugccaag

SEQ ID NO: 4193037 - RNA, 56 nt, Human
cuuggcauguuguagguuacuucuuggcucagauugaauguauauuuuaugccagg

SEQ ID NO: 4193038 - RNA, 88 nt, Human
cuuggcauugggcuaucgugcuggaugcuuuguuccagguaguagagcucccggcagcauugccaauccagacaucagccucgccaag

SEQ ID NO: 4193039 - RNA, 120 nt, Human
cuuggcggacacacucaguucucaugauguaccaggaucaccgacugccuguaagugaaaaugcaggccuuggcaaugagccugagcacagucccuggagcuuacaguggucacguaaag

SEQ ID NO: 4193040 - RNA, 57 nt, Human
cuuggcugccagcacugguguagagugacaguuuccucauccgucuugguagcuggg

SEQ ID NO: 4193041 - RNA, 61 nt, Human
cuuggcuguugggcauugagaaaauguugaacugaaugaaucaaugacuuaggcagccagg

SEQ ID NO: 4193042 - RNA, 73 nt, Human
cuuggcuuacuauaaugcucuuagacguuuguauuggguuacuagugcuuuaagagauuguuaguacuuuaag

SEQ ID NO: 4193043 - RNA, 78 nt, Human
cuuggcuuugaugcuuugguggugguuacuccaaaaguuucaaguuuuguaacaucaccaucaaaauccagauacaag

SEQ ID NO: 4193044 - RNA, 85 nt, Human
cuugggaaaucagcucaagaaaaugcugauacucuggcuacugguacagcugugaguaauaaagucauuuuuucucugacccagg

SEQ ID NO: 4193045 - RNA, 57 nt, Human
cuugggaagaagaaugaggggugauuuguuucaaucacauaauccuucauccacagg

SEQ ID NO: 4193046 - RNA, 72 nt, Human
cuugggacaguggcaguauuagggcagaucccguccgggccuucugcccaggcagugcugcauccucccagg

SEQ ID NO: 4193047 - RNA, 58 nt, Human
cuugggacaguuggacaucuuagcugcuccccagccccugcaauguccauguuccagg

SEQ ID NO: 4193048 - RNA, 70 nt, Human
cuugggaucacagucuguggguugguuuccaaguaccugucuagaaaaccugagucuguguuuuccuaag

SEQ ID NO: 4193049 - RNA, 61 nt, Human
gaaaaugaacaaguauuugcaugagcaguaguuugacugcuuauuauacuuugcucuuuuc

SEQ ID NO: 4193050 - RNA, 82 nt, Human
gaaaaugaguuggguuugaguguuaacuuauugacuggguaaauuuagauaagucaguuaaccucacagcaucucucuuuuc

SEQ ID NO: 4193051 - RNA, 78 nt, Human
gaaaaugggcucagaguuugaaauaauuuuuaggguuauguuuguaaaacuuaaauucuagcuuccugucacauuuuc

SEQ ID NO: 4193052 - RNA, 89 nt, Human
gaaaauggugaaguguaauuuagcauaguaugaacaaacaucgauauugacuacagcuaauuugcucuuauaccuuuccauguauuuuc

SEQ ID NO: 4193053 - RNA, 65 nt, Human
gaaaaugucucaucaagggguccccggauuuuucugcuccgggaaggcugccugagggauggauc

SEQ ID NO: 4193054 - RNA, 100 nt, Human
gaaaaugugggaacauggguaaggcugaaggaaagugcacacucaagacacccuuccccauuuguucacucuucucugucacccauguauuccuauuuuc

SEQ ID NO: 4193055 - RNA, 79 nt, Human
gaaaauguguucacuggagaaaaguaauguauaauugcauauaugcuauacuuccuuuuuucuucaguguuuuguuuuc

SEQ ID NO: 4193056 - RNA, 66 nt, Human
gaaaauuaauuucucucucaugcuucauguccaaaggauaucagcaaggaggagaggugcuuuuuc

SEQ ID NO: 4193057 - RNA, 90 nt, Human
gaaaauuccuggauggacaaauuagcugucaaugaggaucugggaagaucacgagaauccucuucaguaaauucuuucuggugaguuuuu

SEQ ID NO: 4193058 - RNA, 98 nt, Human
gaaaauuggaacaaagaaauaacagccuugauauuaauugucuugcuuaucugucuaaagcagggcugaggaacauauuuuguuuguuuuaguucauc

SEQ ID NO: 4193059 - RNA, 71 nt, Human
gaaaauuggucugcacagccaggauucuucaaaucccuaaagaagcacaucuccugugcagaacuguucuc

SEQ ID NO: 4193060 - RNA, 84 nt, Human
gaaacaaaggauuauuggaacauugcacaguaacaucuaagcaaagggaauguuacagugacuaauguuuuauguaccaguuuc

SEQ ID NO: 4193061 - RNA, 73 nt, Human
gaaacaacaauugggacccaucuaguguguggugugaaaacaacacugucugggacucaggagucuuuguuuc

SEQ ID NO: 4193062 - RNA, 90 nt, Human
gaaacaagaagucugagaucaaggagucaacagagcugguuucuucugagagcccucucauuggcuuauugauagcugucuucuuguguc

SEQ ID NO: 4193063 - RNA, 129 nt, Human
gaaacacuaaguucaagaaacauuugcaaguagagugaaguaauuguuaggauuuacagaagauuuuaaagaugcaauuauuauucuucucaugugugaauuugucugcauaugacuuccagcguuuuc

SEQ ID NO: 4193064 - RNA, 67 nt, Human
gaaacagccccugugugaagcagcugcuggucuccacagugucuaugcucccaccauggccuguuuc

SEQ ID NO: 4193065 - RNA, 55 nt, Human
gaaacaugucugacaauuuaccuuuucauacuagaaaugguggaugacauguuuc

SEQ ID NO: 4193066 - RNA, 74 nt, Human
gaaaccaaaguguagcauuuaccagaaacguacaugguaaguuaaugggugcaaaaugcaggcucuuuguuuuc

SEQ ID NO: 4193067 - RNA, 130 nt, Human
cugcuugccccuuaagucucuagccccagguacaaugugaccacagguucugcucaacagacuucaggaauuugaagaacagguucuagaaccauuaguguuaugugugugcugacguauaugcaggcag

SEQ ID NO: 4193068 - RNA, 74 nt, Human
cugcuuuagguuuauuguuuacuaguuugcagaucuuugagaucuaugcuagaaaauaauugcaggaaaaguag

SEQ ID NO: 4193069 - RNA, 94 nt, Human
cugcuuugucuuccuguuugagaucuuuucagaauuuaucagugucucugagcauguuaaaagucugagugggagagaaaggaaggaaaggcag

SEQ ID NO: 4193070 - RNA, 60 nt, Human
cugcuuuuucuaggaggacaauuauauuuuugauuaauauuguaauuuuagagaaagugg

SEQ ID NO: 4193071 - RNA, 80 nt, Human
cuggaaagcugcaggacccagagccaacuucgugcaaaagagaaauaaaccuacguaugcucaggugcugagauuuucag

SEQ ID NO: 4193072 - RNA, 79 nt, Human
cuggaaaggguguugcuggugcuuugccagaggaggagucccugcccucccuccuggccgucaccgcugcccuccccag

SEQ ID NO: 4193073 - RNA, 84 nt, Human
cuggaacaggauaaaauggcuauugagugaucucuagaggauuuuuugauuuucaggacaauagugauuuuuacacugguucgg

SEQ ID NO: 4193074 - RNA, 90 nt, Human
cuggaaccucacucacuggaagaggaagccagcuggaccuugccugcagggugcagcugggucugcccuggcuagguguugagggcccag

SEQ ID NO: 4193075 - RNA, 68 nt, Human
cuggaaccugggaggcugaggcugcagugagccaagauugcgccacugcacuccagccuuggcaacag

SEQ ID NO: 4193076 - RNA, 121 nt, Human
cuggaacucaagucuucucauauaucauguccuugcacauccuauucaguucggucggguucaugcagcucuacagacagagcaggugggauagcaggaggguuaagagcaacuguuccag

SEQ ID NO: 4193077 - RNA, 73 nt, Human
cuggaacuccuggggagcugguggucaggauauagaaaauccagcuccagaccugcugucccaggagggccgg

SEQ ID NO: 4193078 - RNA, 96 nt, Human
cuggaacucuguucuugacagcaaagcagagccaaggcuucugcugccuaaugagaagaugcccugguucugccuuuugucuucuugaguucucag

SEQ ID NO: 4193079 - RNA, 56 nt, Human
cuggaagaggggaaaugccaugucuucugacuggggaggcugccuuuccuuaccag

SEQ ID NO: 4193080 - RNA, 57 nt, Human
cuggaaggagaaggaggcugugucccucuggcuggcauguuucccagucuccuucag

SEQ ID NO: 4193081 - RNA, 55 nt, Human
cuggaaggggcagucuuugggcaacucauucacccauguacuaucucccuuccag

SEQ ID NO: 4193082 - RNA, 61 nt, Human
cuggaaggguuugucucccucaaggcguaaagcgcuaggauuugaaugcagauccgcccag

SEQ ID NO: 4193083 - RNA, 65 nt, Human
cuggaaguccaagauuaagguguggguggggcucguuccucccaaggccucuccuuggcuuguag

SEQ ID NO: 4193084 - RNA, 64 nt, Human
cuggaaguccaugagugacuugucucauagcacccaaaacaccuuauuucacauggacuuccag

SEQ ID NO: 4193085 - RNA, 58 nt, Human
cuggaagugggguuggcuugaacgagauguuuuauggugucacaaaccccauuuuaag

SEQ ID NO: 4193086 - RNA, 73 nt, Human
cuggaaguguuguaaguuuaaugucaauugcauacauuuauuuaauuucaauagcuugcauaaugcugcccag

SEQ ID NO: 4193087 - RNA, 66 nt, Human
cuggaaucugagacuauggagaaaaagugacuuuuguauuuuuucuguaaacuggccuuucuccag

SEQ ID NO: 4193088 - RNA, 71 nt, Human
cuggaaugcucucaggucagcuuuagagugaaggcaaucuuuacaaaucauacaucuguccuggagcucag

SEQ ID NO: 4193089 - RNA, 127 nt, Human
cuggaaugucacaucagagccgcuggaaugucacaucagagccgcuggaaugucacaucagagccgcuggaaugucacauuggagcugcuggaaugucacaucagagcugcuggaaugucacaucag

SEQ ID NO: 4193090 - RNA, 111 nt, Human
cuggaauuuugauguggagauuugcucugauauuuaacaagacagagaacugggucauucuguugauauugccuuguagauuccagaggcaacauuuccagaaaauuuuag

SEQ ID NO: 4193091 - RNA, 62 nt, Human
cuggaccagcacggauuagaaugcuuucuucauugcagaaaguucuauuagugcuggucuag

SEQ ID NO: 4193092 - RNA, 61 nt, Human
cuggaccucuccuccccaggcccacaccauguaccaaguggggcugauggagacggaccag

SEQ ID NO: 4193093 - RNA, 74 nt, Human
cuggacucuccucugcguucugaagcaccagugccauccaggcagcuuccucaccucagaggucuggauuccag

SEQ ID NO: 4193094 - RNA, 75 nt, Human
cuggacuugcugccugcccugggucaucuguucuggcccaucagcgccgaggacaaggagcagcagcccacccag

SEQ ID NO: 4193095 - RNA, 62 nt, Human
cuggagaagagguaguauguaguuugcuuuugauuucaaaaugccaccucuucugauuccag

SEQ ID NO: 4193096 - RNA, 71 nt, Human
cuggagacaaggagcggggcagggcccugggugagacaggaggcagcuggccccuuuccuuguuaauccag

SEQ ID NO: 4193097 - RNA, 92 nt, Human
cuggagagcuuuuuaaaaauugucauuucugugcccuacccaccugaggucuggcauggggcccaggaaucugcauuuuaugagcuccccag

SEQ ID NO: 4193098 - RNA, 55 nt, Human
cuggagagugaugaaugguuaaacagcaauugguugucuuuggccucauucccag

SEQ ID NO: 4193099 - RNA, 100 nt, Human
cuggagcauagccacaccgacaucuuugcauaucguuccuaucugucagugugacaugacagcagaguugaguaguugcaaugcagguuguuuagcccgg

SEQ ID NO: 4193100 - RNA, 69 nt, Human
cuggagcauccaugcccagggucaccuagcccagggacaccuuagcuacaacccaggguugauguccag

SEQ ID NO: 4193101 - RNA, 81 nt, Human
cuggagccaggcugacugguucaggucccgcucugucaucuccaaguguguggugggauucugaaccugucuuggccucag

SEQ ID NO: 4193102 - RNA, 64 nt, Human
cuggagccccagacagggagagacucagagggcccucacccugacaccugggguguauguccag

SEQ ID NO: 4193103 - RNA, 88 nt, Human
cuggagcuguacaguggagucggugauugcugcugaucauaaucaaguauuuuaggagcuuauuuagacauguaucugauagcuaagg

SEQ ID NO: 4193104 - RNA, 65 nt, Human
cuggaggacagaggccaugucugauucaucuuguauucucauauuuggcccagucugcccuccag

SEQ ID NO: 4193105 - RNA, 66 nt, Human
cuggaggagaaggacaaggggccagccacacagccugggcaggggccucugcuuuccaccuuucag

SEQ ID NO: 4193106 - RNA, 71 nt, Human
cuggaggagacggggugccuggagcccugugagcaauagggccacccaccugccccccaggucucccacag

SEQ ID NO: 4193107 - RNA, 55 nt, Human
cuggaggauuagucugaugcucaccagcccuggagguguccagaggaguccccag

SEQ ID NO: 4193108 - RNA, 130 nt, Human
cuggaggcagcagggcgguucacacugugcccggcugacucuguccuuuccuuacgaugaucagcucacagggccucagccagggcagacuuuucaguuccuaacugcccaccugugccugugcacccag

SEQ ID NO: 4193109 - RNA, 59 nt, Human
cuggaggguggagagaagucucagcugcccacucaggaagucacuucccaccccuccag

SEQ ID NO: 4193110 - RNA, 68 nt, Human
cuggagguaaaaggcuaccacuuaugguccccauuuugcucucaugugucacagccuuuuauugucag

SEQ ID NO: 4193111 - RNA, 60 nt, Human
cuggagguugucuccuagcuguaagcucucagcuuguauuaggaagaaugcuuucaccag

SEQ ID NO: 4193112 - RNA, 66 nt, Human
cuggaguccagggccaucuccaugaggccguccacggccaggcugaggcucuggaagacccuccgg

SEQ ID NO: 4193113 - RNA, 59 nt, Human
cuggagucggcgccccaacagaaguacaucccgcuucugcgcccugucgccugcuccgg

SEQ ID NO: 4193114 - RNA, 90 nt, Human
cuggagucuaauuucuaaguuaauccaugcuugccuuauaaguaccuuaaccaaauagacuguaauggaagugggauugcaugacuucag

SEQ ID NO: 4193115 - RNA, 71 nt, Human
cuggagugaguuggaaaacagacacucaugagacgggccuaucucugugucuguuucccagcucuccccag

SEQ ID NO: 4193116 - RNA, 59 nt, Human
cuggagugcaaugaacaaggucacgaaggaugcaaaggugaccaacucagcauuucuag

SEQ ID NO: 4193117 - RNA, 80 nt, Human
cuggagugggauugucuucagagugagcagugucaucguacaucauaacaaugaugugcucgucuggaaucccauuccag

SEQ ID NO: 4193118 - RNA, 63 nt, Human
cuggaguuaaagaggcagguuaaauaauagagacgggcuauucuuuaguuggcuucuugccag

SEQ ID NO: 4193119 - RNA, 121 nt, Human
cuggauaaucagaaccuguaaacauuuccaagaaauguucggaaguacuucuggaggaguagaucuccugcagcaauguaguuugggacaugcuuuauuauguuuacagguuacagaacag

SEQ ID NO: 4193120 - RNA, 77 nt, Human
cuggauacuuaucaugacuucaagcauccaggacucuguccuggguauccugagccugaguguguauguguguccag

SEQ ID NO: 4193121 - RNA, 67 nt, Human
cuggauagauuaauccugacucgaggaauauagggugauuucuugaaagaggcaaaguuugauccag

SEQ ID NO: 4193122 - RNA, 60 nt, Human
gaaauauuagguuggagcaaaaguaauugugggccauuuuugcaacaaccuauauauuuu

SEQ ID NO: 4193123 - RNA, 68 nt, Human
gaaauauuguuucuggcuguggcagcuuucaucucugaauguuccuuagcagccagagauaauugguc

SEQ ID NO: 4193124 - RNA, 63 nt, Human
gaaaucagagggggugaggacugaggaaaggccacuggcuuuggcaaucuuccuuuugauuuu

SEQ ID NO: 4193125 - RNA, 61 nt, Human
gaaaucaugagaucucuuggacaccuuuaauuuuagugucuaagggcuuguucuugauuuc

SEQ ID NO: 4193126 - RNA, 74 nt, Human
cuggcagcucugugguggggcagaguuugcaggaagcuuguuccugaaacuggcucagcuaacacgagggccag

SEQ ID NO: 4193127 - RNA, 59 nt, Human
cuggcaggcacucaugaaauaagcugaauuguguuuaauuagguuuggggcuuugccag

SEQ ID NO: 4193128 - RNA, 55 nt, Human
cuggcagucugccucuucaccauagcuggcugcaaguuuagaggagaguugcugg

SEQ ID NO: 4193129 - RNA, 66 nt, Human
cuggcaugcacagcccuguucgggagcagugucuguuuucuugucugagcagugcuuugcaguggg

SEQ ID NO: 4193130 - RNA, 59 nt, Human
cuggccagcauuuuugcuuuagccuuaggcauggcuugaguaucaucaugacugguugg

SEQ ID NO: 4193131 - RNA, 55 nt, Human
cuggccaggcucugcaggcuggcaucuuuagcaagcagaaaugccauggcaucag

SEQ ID NO: 4193132 - RNA, 57 nt, Human
cuggccagguuuugaacaguugcagagaaagugugcuuacuguaacagaguggcuag

SEQ ID NO: 4193133 - RNA, 59 nt, Human
cuggccccacuggacagugggccucauccaccuaacaguccauccaucaguccagccag

SEQ ID NO: 4193134 - RNA, 105 nt, Human
cuggcccccgcagaacuacaagucccagcagccccuggggcuaaccaccuuagcauaggccuggcuuccuccuggggcucaugggauuuguaguuuuauggccag

SEQ ID NO: 4193135 - RNA, 58 nt, Human
cuggccccgguuccuaaaaaccgcagucuugcugggauuaugugggagcugggacuag

SEQ ID NO: 4193136 - RNA, 60 nt, Human
cuggcccuugacuuacagcagggagaauuuuggcuugguguaugaguuuaugggcuccag

SEQ ID NO: 4193137 - RNA, 105 nt, Human
cuggccgcagugcccggccggcccaggccacacggcggcucccugcuccugcagcugugugugugcguccugcucgugcuggcccugggccuauacugcggccgg

SEQ ID NO: 4193138 - RNA, 60 nt, Human
cuggccugcagaucccagggucuggcauccuguuucauccccuggaauccugagugccag

SEQ ID NO: 4193139 - RNA, 67 nt, Human
cuggccugggcuccgggaguuacuacucagaucugaggaaggugagggcccccggggcuuggguggg

SEQ ID NO: 4193140 - RNA, 77 nt, Human
cuggccuugggucucugugccuucuccccaccccacagauuugguggggaacauggcaggaggguaagcaaggucag

SEQ ID NO: 4193141 - RNA, 127 nt, Human
cuggcgacccgcacuccagcgcucucugcuuccagucuggccacagcaggggcagauggccugucaggucugaggaaccugcuggcacgugacugggaaguaacgggaggcgagugcaaguugccag

SEQ ID NO: 4193142 - RNA, 62 nt, Human
cuggcgcuggaaaucauauuuuguuguaaaaccuaauacuagcucauugugauccagccuag

SEQ ID NO: 4193143 - RNA, 99 nt, Human
cuggcggggccgggcuucuggcagcuccuggggccagcacgucccuuccagagcgucugaagcccugggcggcugcuggagcaucucgagucuuuccag

SEQ ID NO: 4193144 - RNA, 105 nt, Human
cuggcuaauucuaccauccuagauucuugauuuuuuucuacuaugcgccagcugaaaauagaguguaaugauugaagaggucaaggaucugaaauagaauucuag

SEQ ID NO: 4193145 - RNA, 55 nt, Human
cuggcuacccuucucuagcaugcuuugugcugccuaauaagucgagggugguuag

SEQ ID NO: 4193146 - RNA, 61 nt, Human
cuggcucacuagcccugcccugcucugggcuuucccagccuggggcuccccugguggccgg

SEQ ID NO: 4193147 - RNA, 58 nt, Human
cuggcucaucauuuuuagcgcgcaaaaguuucaaaacuuuccgccuagugagaggcgg

SEQ ID NO: 4193148 - RNA, 103 nt, Human
cuggcucccugcuggguagugcugcagcauuaguacaagucucaugcucugaagggugaaaugugaugaucugcuaagugaaggcucugucaggagaagccag

SEQ ID NO: 4193149 - RNA, 58 nt, Human
cuggcucccuggacauggggccuggggaguuuggugcccacgugauagggacugcuag

SEQ ID NO: 4193150 - RNA, 73 nt, Human
cuggcucucuugcaucuccucucugaugguuuggauuuggaguaucaggaagaagaauguguugggagcucag

SEQ ID NO: 4193151 - RNA, 68 nt, Human
cuggcucuguuguaaagaaauuuugggcucacaucccaggauugauuccacugcaacaggauugucag

SEQ ID NO: 4193152 - RNA, 78 nt, Human
cuggcugacuugaugguuuuuaaaauuccacugacaucucagugauggggaauuucaaaagccagaacggggugucag

SEQ ID NO: 4193153 - RNA, 70 nt, Human
cuggcugccacuucagggucuuggcaccucgagcuccaagcuccacuuccagacacuugauggcuuccag

SEQ ID NO: 4193154 - RNA, 68 nt, Human
cuggcuggaguauaggaguaggaaggcaguuacagcugacauuuuauguaauccuuacugucggccag

SEQ ID NO: 4193155 - RNA, 75 nt, Human
cuggcuggcucugugguaguuggcagccauucaagacuggucuugugccaggaguauuacuagauagccagacag

SEQ ID NO: 4193156 - RNA, 62 nt, Human
cuggcugggcugaacccucaggaggugggccuacuguccuggacaacagccccuagagucag

SEQ ID NO: 4193157 - RNA, 62 nt, Human
cuggcuggggcugggcugaggaagaggaggaagcugcucuccuucuccccaccccagcccag

SEQ ID NO: 4193158 - RNA, 81 nt, Human
cuggcugucagaacauuuaaaauaauugaacaaggucauucaccucuucagccuauuugagugcagaucugacgcagucag

SEQ ID NO: 4193159 - RNA, 62 nt, Human
cuggcuuccugaguccauuaccucuuguuggaugagauggaggagauggagcggcaggccag

SEQ ID NO: 4193160 - RNA, 82 nt, Human
cuggcuucucccagggagaugagaggguaccuguucuauggcccagagggcagcaugaggacccucaucccagggaagccag

SEQ ID NO: 4193161 - RNA, 83 nt, Human
cuggcuucuuccccuaauggccuggccacauccagcaggcuuuucacagccuguggcuggucaggccagcagcaugauguuag

SEQ ID NO: 4193162 - RNA, 57 nt, Human
cuggcuugcagcucaucauaaaguaaaaugugguaccaaauggugaaggcaauccag

SEQ ID NO: 4193163 - RNA, 61 nt, Human
cuggcuuucauucauucaggcccuccucucccauccagucuguucugaguacuguagccag

SEQ ID NO: 4193164 - RNA, 57 nt, Human
cuggcuuuggucaugugaucaucccuggauguaaucaccaugaaugaagaaauccag

SEQ ID NO: 4193165 - RNA, 61 nt, Human
cuggcuuuuggaggagggucagaguucacgccgcucucuggaaauaacugcucaaagccag

SEQ ID NO: 4193166 - RNA, 65 nt, Human
cugggaaagaugcaagcuucuguuagccuucaccuagcuggaggcaacugaagauguagucccag

SEQ ID NO: 4193167 - RNA, 64 nt, Human
cugggaacagacgaugcugcuguguuugccaaaggaagacagcuccaagugucucuguuuucag

SEQ ID NO: 4193168 - RNA, 59 nt, Human
cugggaagaaauugugggaggcaaguggguugauucccuauauacaguuucugacucgg

SEQ ID NO: 4193169 - RNA, 67 nt, Human
cugggaaguguaguccgaaguugcgggccggggccaagcaggaggcgcgugggacuacacuucccgg

SEQ ID NO: 4193170 - RNA, 59 nt, Human
cugggacaguucagguagggcaggugagggacccccgaggcccuggagccuuguccugg

SEQ ID NO: 4193171 - RNA, 65 nt, Human
cugggaccuccucacuguucuauaugcaaauggccuugcaccugggcagccgagcgggcucgcag

SEQ ID NO: 4193172 - RNA, 57 nt, Human
cugggacuugcagagcaggagggaccucaagaaguucucguucugcaagcuucacag

SEQ ID NO: 4193173 - RNA, 72 nt, Human
cugggagcuagauucaauaaagcuguucugaccaugaacuuggaacuggccccuuucauucuggaagcccag

SEQ ID NO: 4193174 - RNA, 56 nt, Human
cugggagcucccagucugauggaggagacauggucccugacucugggagcucccag

SEQ ID NO: 4193175 - RNA, 74 nt, Human
cugggaggaguccccugguggcuggagcugcucuggguuugagcagcugcagagaccgggugggaaggucugag

SEQ ID NO: 4193176 - RNA, 59 nt, Human
cugggaggcuucuggauaaggugugagaucccgucuucaugcagccuggaaccucccag

SEQ ID NO: 4193177 - RNA, 57 nt, Human
cugggagggguagccaauccuagccaagaacuacguuaguguuggugcuuuucccag

SEQ ID NO: 4193178 - RNA, 55 nt, Human
cugggagucuggccucugguccucacugagcugaugaccagcuaggugaccuuag

SEQ ID NO: 4193179 - RNA, 85 nt, Human
cugggauguguuaaauuagcaaucugaaaauugcggggaggaacgaaaucagcaagaguugggguuguugggagcggcuucccag

SEQ ID NO: 4193180 - RNA, 82 nt, Human
cugggcaaagucagaaggcuaaaauugaguaggaguuuuuauuagacugggcugguuaguuuuacuaucugagaaugaccag

SEQ ID NO: 4193181 - RNA, 58 nt, Human
cugggcaaauugugccagcuauggguaucaauuuuauagcuuaucccacagugcccag

SEQ ID NO: 4193182 - RNA, 80 nt, Human
cugggcaacuuuucuugauaguaaauaacacuguuaaauaaaacuaaaguguuaugaacuucuagaaaacagcugccuag

SEQ ID NO: 4193183 - RNA, 66 nt, Human
cugggcaaguacugguugaaguguccugaauaaaacagguauccaugccuuugugccuuagcccag

SEQ ID NO: 4193184 - RNA, 68 nt, Human
cugggcacaaguggcccuggauucugggguuccauugccacucaccccccuauucacuuguggcucag

SEQ ID NO: 4193185 - RNA, 56 nt, Human
cugggcagcuaccaccacugcuugugcccccaaccccagcaugguggcuugcccag

SEQ ID NO: 4193186 - RNA, 64 nt, Human
cugggcaggcacuagcagaaugaggcugccuuugggggagccucgcaaacugggcacugcucag

SEQ ID NO: 4193187 - RNA, 91 nt, Human
cugggcaguggaggcagggcaguguggugggacugacucaacagacauaguuucaucuccacccugcccuucucagguugugugaccccag

SEQ ID NO: 4193188 - RNA, 56 nt, Human
cugggcagugguggcaucuuuggacacucuggguuaagcagccauuuacagcccag

SEQ ID NO: 4193189 - RNA, 80 nt, Human
cugggcauacuuuggcugagagaggaaaagggccuggcgaccugcucaaguuuuggauucuuuuuugccuucuugcucag

SEQ ID NO: 4193190 - RNA, 59 nt, Human
cugggcauuuuaucuguuuuguucagugcuuuauccucaggaccuagaaaagugccuag

SEQ ID NO: 4193191 - RNA, 58 nt, Human
cugggccaggaccaggguugaaaacucuagauuggacuagaccuuugauccugcccag

SEQ ID NO: 4193192 - RNA, 79 nt, Human
cugggccccggggcguggggcuggccuugccugggggcuacauccccagcgggugcugugucagcccucgagggcucag

SEQ ID NO: 4193193 - RNA, 129 nt, Human
cugggcccucucucauggccggguuccccgucccucugcagaggcugggaaggguccccgggcuggagccacgggggcuucucugggcugugccuccggggccaacacuggcugcuuggggcugcccgg

SEQ ID NO: 4193194 - RNA, 60 nt, Human
cugggcccugagcacagcuccucuccuugucccaggagagccagcucugccgggggacag

SEQ ID NO: 4193195 - RNA, 57 nt, Human
cugggcccuggacccuccagcuuagaccuagcacugaggugcagagccagggaccag

SEQ ID NO: 4193196 - RNA, 80 nt, Human
cugggccgauaccuaguucccuuuggggccuuucuccucccuugguguaggccagcuuccagaggggcaggguagcucag

SEQ ID NO: 4193197 - RNA, 55 nt, Human
cugggccuggcguuccaggcuggucacagcuucuccagccuggcugccaacccag

SEQ ID NO: 4193198 - RNA, 103 nt, Human
cugggccuugcauacaccuuggcuugucccuggagcaucuucuugccuuguguaggagccugcucugcagggaccagaaucaggguggaucugcauggugcag

SEQ ID NO: 4193199 - RNA, 59 nt, Human
cuuuccaacucuagugaaauuuuaucguaaaauauaugagucauuagccaguuggaaag

SEQ ID NO: 4193200 - RNA, 55 nt, Human
cuuuccaacugggugggcagcuuucugaaguuaaggcuccuguccugguggaggg

SEQ ID NO: 4193201 - RNA, 78 nt, Human
gaaggaugaggagcauuuagguaaguagagggccuagggccgcauuacuguagcuugacauaugucuuuucuucucuc

SEQ ID NO: 4193202 - RNA, 87 nt, Human
gaaggaugaguaaaugaagaugggaaugaugaguggggacagaugucagccccuaauggguucuagucucaucacacucauaccuuc

SEQ ID NO: 4193203 - RNA, 87 nt, Human
gaaggauuuauuuuacuuacuauguggcuugcugaagcaaugucaaguuugauucuguaagucauauuguuauucugguagucuuuc

SEQ ID NO: 4193204 - RNA, 58 nt, Human
gaaggauuugagauuauccuagagagugucucaaaggguaauauuuuuuaaauuuuuc

SEQ ID NO: 4193205 - RNA, 72 nt, Human
gaaggcaagaucucaguggaggccuucaagcaaauccccuaaaaggagcccuucgaugucuucuuugucuuc

SEQ ID NO: 4193206 - RNA, 55 nt, Human
gaaggcaagcagcauaaaugucuuuaaagaugugcacccuggugcuuuugucuuc

SEQ ID NO: 4193207 - RNA, 58 nt, Human
gaaggcaaggcuuccagcuccccuuuggaugcaccacugggaagucccgccugucuuc

SEQ ID NO: 4193208 - RNA, 56 nt, Human
gaaggcacccggcgugcggcggcgcuggguuggaaccgccgacuccgcgggucuuc

SEQ ID NO: 4193209 - RNA, 84 nt, Human
gaaggcagcaagcugccugcucggcuccugggagcucuggccaggcuggaagaaucaccaacccagcaggcagccuuugccuuc

SEQ ID NO: 4193210 - RNA, 99 nt, Human
cuggugguggaaaucuggugguagaugggaagaagauaaugugcugaaguucucuuaucacugcuucaguuuucccagugaaauaaaaaaaaucaucag

SEQ ID NO: 4193211 - RNA, 98 nt, Human
cuggugucagacaggaagccuaagcgcagguaucacugaggaggauacacaugcuaacuacacgaucuucaccagaccugugagcuuccagccaccag

SEQ ID NO: 4193212 - RNA, 70 nt, Human
cugguguggcucaugugguugguccuacuugcccugugugucggggcugccagccauaggccagcacugg

SEQ ID NO: 4193213 - RNA, 61 nt, Human
cugguguuuggaguuaccgcucuugggguccuucagagcugcgucuauucacaaucaucag

SEQ ID NO: 4193214 - RNA, 93 nt, Human
cugguuacaaaugcuucuguguuacacaucagucuuuagagguuugcagguaucuguugccugcagagauugaacaagaaggaaaacugccag

SEQ ID NO: 4193215 - RNA, 78 nt, Human
cugguucucaggccuuugaacuuggaguggggcuuauauuaucaccucccaacccccuucucaggccuuuggacucag

SEQ ID NO: 4193216 - RNA, 73 nt, Human
cugguucugagguaugugggacuagccuggcuggcugaccaggcuucuugagccccacaggccucuuucacag

SEQ ID NO: 4193217 - RNA, 60 nt, Human
cugguugaauccuugagggcaagaacucuauccuuucaugccacaggguccucaggccag

SEQ ID NO: 4193218 - RNA, 61 nt, Human
cugguugccuaggggagcugacuugggcucuucucagucuccuuuccucuagacaugacag

SEQ ID NO: 4193219 - RNA, 62 nt, Human
cugguugucagacaugaugccacauguuuuguguucaucccaaugcugauagaaucugccag

SEQ ID NO: 4193220 - RNA, 67 nt, Human
cugguugugcuggccugguuagaaagggguuucuaggcagaggagccccuggguuuguaacagcugg

SEQ ID NO: 4193221 - RNA, 67 nt, Human
cugguuuaagcuuauauaguugugauuuagcuaucauaugccucauaacaaauacaagcuuuacuag

SEQ ID NO: 4193222 - RNA, 68 nt, Human
cugguuuagucauaauggagaaauguccuucaguugcaugaugcucuuccuaugaaugaggaaaccag

SEQ ID NO: 4193223 - RNA, 66 nt, Human
cugguuucugaauucaugagauuuggguuaggcuacccuacucuccuggauucaggaggcacccag

SEQ ID NO: 4193224 - RNA, 84 nt, Human
cugguuugcccuccuuugcuucugcgagcugcucagauagcacuagaucucugcagcuugcacaggcaggccaaauucaaccag

SEQ ID NO: 4193225 - RNA, 56 nt, Human
cuguaaaacugcuuaaguaugcuuuuuggggagacauugagcaaggcggugaacag

SEQ ID NO: 4193226 - RNA, 68 nt, Human
cuguaaaguccaagaucaaagagccagcauuucgauuccuagugagggccucuuccuggaguuugcag

SEQ ID NO: 4193227 - RNA, 58 nt, Human
cuguaaccuccucuuuccauuccaugccuuguggaauguccucuuuagaggguuacag

SEQ ID NO: 4193228 - RNA, 81 nt, Human
cuguaacucaaauguguagugcuguaacucaaaucucuucaaauauauuuuguaguacuguacucaacaugugaguuuugg

SEQ ID NO: 4193229 - RNA, 68 nt, Human
cuguaagaauuaucucauggauaauucauggauaacuauuagaauuaucucauggauaauucucaugg

SEQ ID NO: 4193230 - RNA, 129 nt, Human
cuguaauaaacagcaacuugacuccaugugucaugagguuaauaguugagaucagauucaacugcuaaaauaguugacaucagauucaagugccuccucagcccaucaaagucacugucaaacaaucag

SEQ ID NO: 4193231 - RNA, 71 nt, Human
cuguaauaaagagccuauauucagcugcagccaauuaugucuaggcagaauugugggcucuaagcuaacag

SEQ ID NO: 4193232 - RNA, 58 nt, Human
cuguaauccagucugauguccuuauagggaaaggaaaucuggacacagauagguacag

SEQ ID NO: 4193233 - RNA, 68 nt, Human
cuguaaucccagcuacccaggagacugaggcaggagaaucgcuugauccugggaggcggagguugcag

SEQ ID NO: 4193234 - RNA, 57 nt, Human
cuguaaucccagcuaccugggaggcugaggcuugaacccgggagguggagguugcag

SEQ ID NO: 4193235 - RNA, 68 nt, Human
cuguaaucccagcugcuuggagggcugaaguaggagaauugcuuaauccugggaggcggagguugcag

SEQ ID NO: 4193236 - RNA, 74 nt, Human
cuguaaucuuguuuagcuguuacccacuagggaaagaaugguuuucucucagucagaugcuaaagagauuaaag

SEQ ID NO: 4193237 - RNA, 60 nt, Human
cuguacaggccaccacugaauuuuugccuuaaaaaaaauuuagcaucguggcuugucugg

SEQ ID NO: 4193238 - RNA, 61 nt, Human
cuguagaggugagauauuuuauuuugcuguacacugucuguaaagcaaucucuucucuuag

SEQ ID NO: 4193239 - RNA, 96 nt, Human
cuguagaguaaauccuguccuuuugaauagaauguaaucuaauacauuaaaaaauguccugaggcuuuuauuuuaaaggcagugauauugcuacag

SEQ ID NO: 4193240 - RNA, 75 nt, Human
cuguagcccauggcuuuuagcccuacaugaguuugggacagcaaucacauaggaaugaaaagccauaggccacag

SEQ ID NO: 4193241 - RNA, 64 nt, Human
cuguaggacauuuuagcuacauauuucuguaucagaaauaaguuaaacuagaaugaucuuagag

SEQ ID NO: 4193242 - RNA, 63 nt, Human
cuguaggccaccaaaagggaccuuauuucucugaccucggucaccuccuggucaggugugcag

SEQ ID NO: 4193243 - RNA, 80 nt, Human
cuguaggugaggggcugcgacacuucugucugcagcggccaucugucucugacagcgagagaguugcccccuuccugcag

SEQ ID NO: 4193244 - RNA, 68 nt, Human
cuguagucccagcuucucaggagguugaggcgggaggauugcuuaaacccaggaaguuguggcugcag

SEQ ID NO: 4193245 - RNA, 75 nt, Human
cuguagucugguguggugcccagugaccacgugccucucgaucugcaucauccugggaccaggcaccuacugcag

SEQ ID NO: 4193246 - RNA, 56 nt, Human
cuguaugaaauuaaguaaacagugcuuaccuguacggacugcuuaggcucuugcag

SEQ ID NO: 4193247 - RNA, 60 nt, Human
cuguaugauuccauuucuauaacauccucaaaaugacaaaauuauagagauggagaacag

SEQ ID NO: 4193248 - RNA, 80 nt, Human
cuguaugguaauggcuggaucucuuuggcuuugaaugaaaaagcuaauauuuguugagaaccuacuguauacuauaucag

SEQ ID NO: 4193249 - RNA, 68 nt, Human
cuguauguguacaggacagaaaggaggggaguuucuuguuccgcccuccucuucggcuggccaugcag

SEQ ID NO: 4193250 - RNA, 58 nt, Human
cuguauguuucuaugaaugugacuauuuuagauaccucauguaaguggaagcaugcag

SEQ ID NO: 4193251 - RNA, 80 nt, Human
cuguauuagaacucuuggaaguucuuagccuuuucagguuaugaaauaccugaaaguaaaauuuucuaagauuuaauaag

SEQ ID NO: 4193252 - RNA, 67 nt, Human
cuguauuuucaugccuacguacaauuuguucaaacauucugguaugugcuaggcaccgaggauaugg

SEQ ID NO: 4193253 - RNA, 60 nt, Human
cugucacacugauaucaggcuugaccacaugauuuucuuggccugaugaaaugugaguag

SEQ ID NO: 4193254 - RNA, 68 nt, Human
cugucacccaggcuggagugcagugaugcaaucucggcucacugcaaccuccaccuccuggguucaag

SEQ ID NO: 4193255 - RNA, 68 nt, Human
cugucacccaggcuggugcgcaguggcaugaucacagcucacugcaaccucagccuccugggcucaag

SEQ ID NO: 4193256 - RNA, 55 nt, Human
cugucaccuguucacugcagcaccucguuaggugaguagcaggccagggugacag

SEQ ID NO: 4193257 - RNA, 65 nt, Human
cugucagaggcucucuguugccaccagcugccuggccaugacaucgcagagagaccaucuugcag

SEQ ID NO: 4193258 - RNA, 77 nt, Human
cugucauagccaagaggagccuaaagcgacaugacuacuaaauguagugugguaucuucuauggaauccuggaacag

SEQ ID NO: 4193259 - RNA, 84 nt, Human
cugucaugacuauauaucucagagaaauuugaaugcaauuaccagagugaauguaaaaaguuucugugauauauacaugggcag

SEQ ID NO: 4193260 - RNA, 69 nt, Human
cugucauucugagauaugggcugaaggaacauccucucccugaggcuuugcuaguguuucaguagacag

SEQ ID NO: 4193261 - RNA, 57 nt, Human
cugucauugacagaacucaaauugugauaggcaaauuggcuucaaugucagagacag

SEQ ID NO: 4193262 - RNA, 55 nt, Human
cugucauugagccugucagggcccaaccaacauggccccaugugcucaggggcag

SEQ ID NO: 4193263 - RNA, 60 nt, Human
cugucauuggcagggagugugugcugacacugcccagcccucacugccuggcgaagauag

SEQ ID NO: 4193264 - RNA, 80 nt, Human
cuguccaacauguuauggcuaaauuucaauauuaguaauauuauuaguaaauaauuauuagauauaguaugucuggagag

SEQ ID NO: 4193265 - RNA, 63 nt, Human
cuguccagaauaggcaaauccauagagaaagaaaguagaguagugguugccuagggccggcgg

SEQ ID NO: 4193266 - RNA, 80 nt, Human
cuguccagaugccuguggggcacuacagaguuuugaggaaauagagucucagacuggagccccaaggaccuugaggacag

SEQ ID NO: 4193267 - RNA, 61 nt, Human
cuguccagcgacuaggggauggagccaaugccgugcgagcaaaucccuugucgcuaggcgg

SEQ ID NO: 4193268 - RNA, 55 nt, Human
cuguccagucuuuagcaagcuggaaccuuuugguuugcuccugaguacuggcuag

SEQ ID NO: 4193269 - RNA, 61 nt, Human
cuguccaguuguauguccagugucucuguaauuaagaugaugaggaccuacagguggccag

SEQ ID NO: 4193270 - RNA, 83 nt, Human
cuguccaucuuucugucuguuaucucaccaguccccacuacugggagaccccaauguggcagauuagaaggagcacuggacgg

SEQ ID NO: 4193271 - RNA, 56 nt, Human
cugucccagccccguacucuaacaauguugaaguuagggucuccggcgcggcacag

SEQ ID NO: 4193272 - RNA, 63 nt, Human
cugucccauacuaucugggugauguucuaacucucaacugccucaucuauaaaauggagacag

SEQ ID NO: 4193273 - RNA, 61 nt, Human
cugucccuagaaaugaaagcauacguccacacaaagacuuguaugugaauguuucuagcag

SEQ ID NO: 4193274 - RNA, 129 nt, Human
cuguccgaguucaucagccgcuacaaguccuccggcuucaucgaccugcuccacgacaagugguacaagauggugccuugcggcaagcgggucuuugcgguuacagagguggggcagggccugggacag

SEQ ID NO: 4193275 - RNA, 66 nt, Human
cuguccgucugucucuccuucucaaucccuucaagcucagggaagaaggguccuuggcagcgacag

SEQ ID NO: 4193276 - RNA, 106 nt, Human
cuguccucacuuucaguugucagcagugcuucagugugagaugaaauaaauugccaagcccuuucaucuucuauaaucagcucugcacagcugaguacacccacag

SEQ ID NO: 4193277 - RNA, 84 nt, Human
cuguccucuuggcagcagaguguggugcucaggaggccaccuggcaccugucagcucugccuuuggcugccgucugagagacag

SEQ ID NO: 4193278 - RNA, 74 nt, Human
gaaggcugcagggaggggagagaacaggaggaucccgggccagggugacuucagugacauuccuucccuccuuc

SEQ ID NO: 4193279 - RNA, 56 nt, Human
gaaggcuggcaaagauccaacacggcagcauuucuugcuucgguuugccaggcuuc

SEQ ID NO: 4193280 - RNA, 73 nt, Human
gaagggaaaggaaugagcuucuguuaggcacccacgacacacuggguccuuaaauccaucauuucuaauccuc

SEQ ID NO: 4193281 - RNA, 66 nt, Human
gaagggaaauggccaggcagagacuucuugugaacaaaagcugucccuucuacucuguuuuccuuc

SEQ ID NO: 4193282 - RNA, 55 nt, Human
gaagggaacugucuggcaaagcauaaguggaugcauccagagcucaguccccuuu

SEQ ID NO: 4193283 - RNA, 71 nt, Human
gaagggaaggaagucauuagugcagacugagcuguggaguuggguucuugcaggauuuccuuccagccuuu

SEQ ID NO: 4193284 - RNA, 69 nt, Human
gaagggacuggggacuggggagggaagcaugggguuuuagaguugcccaccuuagucuucagacacuuu

SEQ ID NO: 4193285 - RNA, 59 nt, Human
gaagggcucgguagcaguccugaggcucauggcgccuagagaaagccaccgagucucuc

SEQ ID NO: 4193286 - RNA, 55 nt, Human
gaagggcugaucucacuuucuuuucuccacuccaggaaugaaagcaaagcccuuu

SEQ ID NO: 4193287 - RNA, 82 nt, Human
gaaggggcauccugcagcuccucugucagagggauuccugccggagcaccuccuggcagagagcaugaggcccggccaauuc

SEQ ID NO: 4193288 - RNA, 77 nt, Human
gaaggggggaaaauuagguccuggaaauugacggaaagcuguuuggcaucuugaaauuaaccaggacucccccuuuu

SEQ ID NO: 4193289 - RNA, 75 nt, Human
gaaggguaacagaaauagaaaugagaguccgacaagagaaaaggacucuguuacugggaucuggggccacccuuc

SEQ ID NO: 4193290 - RNA, 69 nt, Human
gaagggugcaagcuucucugugugcaagugucauugucuagagaguacacaguucugccggcaucuuuc

SEQ ID NO: 4193291 - RNA, 57 nt, Human
gaagggugcuggaaucagaccgaaccguugguuugaaccugagcuucugcaugcuuu

SEQ ID NO: 4193292 - RNA, 85 nt, Human
gaagguagaugcagaagaugcagugucugagaauuuucaagauuguauuucucucauaagcaucaaucacagugcaucuuucuuc

SEQ ID NO: 4193293 - RNA, 95 nt, Human
gaagguauggacuuggcuaaauugaguuauagauggacuauuauuuuacaucaaaucauugucgaauggcaucuguagcuuuuaaguuuacuuuc

SEQ ID NO: 4193294 - RNA, 68 nt, Human
gaaggucaguagggaaggccaacuucaugugcaaagagcaauauguguguauuucuuacuagcuauuc

SEQ ID NO: 4193295 - RNA, 74 nt, Human
gaaggucuuaccaugcugaggaggugggacuugauccuguagucaggggaaaucucucagcgaagcuggccuuc

SEQ ID NO: 4193296 - RNA, 89 nt, Human
gaaggugcauucuguuccauaaguggugcuuuguugcuguguccucacauggcagaaggggcaagguaucucucuggagcucugccuuc

SEQ ID NO: 4193297 - RNA, 65 nt, Human
gaaggugggaggcaggcugcucccauguggugagaacagugggaacagcugggcuucccuccuuc

SEQ ID NO: 4193298 - RNA, 74 nt, Human
gaagguuugaggcaucaggaguauagccagaaccuugagguucuuucuuuggaguuuguugccuguaaauauuc

SEQ ID NO: 4193299 - RNA, 85 nt, Human
gaaguaaguaaauaauagaguauuuugauuauccuggagguuuuucuccagaaaaaguaauuuauuugaugaauuugguuacuuc

SEQ ID NO: 4193300 - RNA, 82 nt, Human
gaaguagauagcagagacauucuccccauuggacagaugcaauaacuaagguucaaacagaugacucugcucuucccccuuc

SEQ ID NO: 4193301 - RNA, 74 nt, Human
gaaguaggcuaggcugaagguuuuggagucuacaaauccugaucucugaguucaaaucccagcucuaccacuuc

SEQ ID NO: 4193302 - RNA, 84 nt, Human
gaaguagguagaaugcauuuuggauggcauauuuucuucuugauuguuucuuuucucuuccagaaugcauucucuuuugacuuu

SEQ ID NO: 4193303 - RNA, 91 nt, Human
gaagucaagacacuauuucuccuccacuguaggauccuguucacugaggagccacagugcaagagagaaaaguuucuuccaaccugacuuc

SEQ ID NO: 4193304 - RNA, 103 nt, Human
gaagucaagauucuggcacuagcaucaaggaauaaaaagaggcaugaagcuucagcuucuuucuguuucucugaagacaccuaaugucuugauucugcucuuc

SEQ ID NO: 4193305 - RNA, 69 nt, Human
gaagucagaauuuuuguuacccuugaggguggagguaguacuucgagggcgcugauaguguucuguguc

SEQ ID NO: 4193306 - RNA, 67 nt, Human
gaagucauauagggcccuggacuuuuggccucugucuucugagauucuuggaacccuaugugauuuc

SEQ ID NO: 4193307 - RNA, 58 nt, Human
gaagucauuuuaccaagauuugucuuuaaaauagcugacaggcuuuagaaaaugacuc

SEQ ID NO: 4193308 - RNA, 100 nt, Human
gaaguccagggagaccuagcacagcuucuccuugauaucgcgcaugauuucccgcugggcuguguuggugaagcuguagccucucuccuugaggaucuuc

SEQ ID NO: 4193309 - RNA, 67 nt, Human
gaaguccaugcuuagaaagugauugauacauguugguucagguaacagaauuuucaagcuugguuuc

SEQ ID NO: 4193310 - RNA, 55 nt, Human
gaaguccgggaggaucauguucauggcugcagugaacaggucccccacgggcuuu

SEQ ID NO: 4193311 - RNA, 64 nt, Human
gaagucucgguuggcuaaaaucagaguaucugacaaguucuggacuugccuugcugaugauuuc

SEQ ID NO: 4193312 - RNA, 56 nt, Human
gaagucugagugggggccaggcucucgggggccugggucaucuccacucaggcauc

SEQ ID NO: 4193313 - RNA, 55 nt, Human
gaagucuuaccuccagguuucuggcaauaugcccuuauuuggaaauaaggucuuc

SEQ ID NO: 4193314 - RNA, 57 nt, Human
gaagucuucauucucucugagaagaagguaagaccaccugagagugaggaaggcuuc

SEQ ID NO: 4193315 - RNA, 72 nt, Human
gaagugagaagcauuuugagccucuaagugaagaccuuacuucagcuucaagguucaaggaugcucuaguuc

SEQ ID NO: 4193316 - RNA, 92 nt, Human
gaagugauccuuaaagcugcagugaauucgcuaacuggaugacauaccagaguggugagauuucugccugaagaagugaaggguccaacguc

SEQ ID NO: 4193317 - RNA, 62 nt, Human
gaagugcauucuccuauuacauuaauaauaauuuuacaguaugguggcaggaaaugcacuuu

SEQ ID NO: 4193318 - RNA, 84 nt, Human
gaagugcuuauuugucaggaaaucuauuucuuaccaaaggauuauuguauguaaagguacugaaauagcacucugaugcauuuu

SEQ ID NO: 4193319 - RNA, 61 nt, Human
gaaguggagccaggagccugggagucaccugcugccucccuguuuccugcuccaaccaguc

SEQ ID NO: 4193320 - RNA, 59 nt, Human
gaaguggugcuaugccaguucuaggcauagcccuuaacugagcuggcagcuuccacuuc

SEQ ID NO: 4193321 - RNA, 130 nt, Human
gaagugguguuuuuuguuuuguguuuaagauuacagcuugcucaguuugcacacaugccuacagcugggcuugguuuuugcaggugcagcgauacugugagaagagcaugaucagcagaaagguaacugc

SEQ ID NO: 4193322 - RNA, 67 nt, Human
gaagugugaaggugauguggagaaugcacaaaaagcuugcucugguuguuaccuuccuagacacuuu

SEQ ID NO: 4193323 - RNA, 73 nt, Human
gaaguguuggacagguggguaccuuuauggaggcucugagggagaaucugugccaugcccgucuaccagcuuc

SEQ ID NO: 4193324 - RNA, 73 nt, Human
gaaguuacacaucuagcacacacuggcagcuuauguucuauuucugcuggacagugcugcuugagaugucuuc

SEQ ID NO: 4193325 - RNA, 78 nt, Human
gaaguuauaugacuuauccaaggcuauaucucaauacuauuggaaucaaaaguagauguggcugagucuucugaauuc

SEQ ID NO: 4193326 - RNA, 66 nt, Human
gaaguuauugcaauucuggcaccuuucuggacuuccuuccagagcagugaggaguuguguaaccuc

SEQ ID NO: 4193327 - RNA, 57 nt, Human
gaaguuccucguaggagucucuaacuaacauguucaagaucuuaaugccaggaacuc

SEQ ID NO: 4193328 - RNA, 77 nt, Human
gaaguucuggccuaauucuuauaauuaaaaguauucuguaauguuagaaaagaacuuaagaaauuaggcuagacuuu

SEQ ID NO: 4193329 - RNA, 64 nt, Human
gaaguucugguguaugugauaaauuaaaaacagcuugucacuuuauagcuacaccuuggauuuc

SEQ ID NO: 4193330 - RNA, 83 nt, Human
gaaguugccuacauuguuggauauugaguaaauaaaaguggcaacauuuucuagcugacaaaaauguuuuacaaagcaacuuu

SEQ ID NO: 4193331 - RNA, 75 nt, Human
gaaguugcugcugaggaguaagcaggggggacucugggccccucaucucauccugcaccugagcagccugacuuu

SEQ ID NO: 4193332 - RNA, 76 nt, Human
gaaguuggacaaauccagaucccagucguagcugugucacugacuagaaugugaucuggguaacauuuuuaacuuc

SEQ ID NO: 4193333 - RNA, 108 nt, Human
gaaguuguuuacauguuugacaaguuugacagaaguuucuaauguuuaaguucucauacauugauaauggaauguuaaacuguaauuucaaaaauaugucuuuauuuc

SEQ ID NO: 4193334 - RNA, 90 nt, Human
gaaguuucgcucuuguugcccagguuggagugcaauggugugaucucagcucacugcaauccccgccucaacaggagagcaggaaucuuc

SEQ ID NO: 4193335 - RNA, 89 nt, Human
gaaguuuggaaugcuuuuuuagacacacuuuguauauuuggaaacuguauuucauaauaugacuuguuugaaauggauagcuagauuuc

SEQ ID NO: 4193336 - RNA, 87 nt, Human
gaauaaaaaggcucuaaauauguaugacuucuaucaauuauccaugcuugaagaaagucauauauaaugagaguauaggaaauguuu

SEQ ID NO: 4193337 - RNA, 59 nt, Human
gaauaaacaaguaguagagcugguguuugaauccagguuuaguucuaccacuugcauuc

SEQ ID NO: 4193338 - RNA, 93 nt, Human
gaauaacuucuggauguuucaaaugugcuuccaaaggauaaaaauuuuccaucccuuaaagaaugaacauuugaggauguuaagaaugcauuc

SEQ ID NO: 4193339 - RNA, 64 nt, Human
gaauaauaggguuauagcaguguuaggcucaauauuguagcuauucugagaauccuacuuauuu

SEQ ID NO: 4193340 - RNA, 70 nt, Human
gaauaaugcaguaagcaauggugaaugcuuggaaugauaacuguaaucaugcaccuguucacugcaguuc

SEQ ID NO: 4193341 - RNA, 78 nt, Human
cugucguucgccgucagucauuaugggaguuaauccugugcuaggaaaugagacggaugacucuacaggugaauucag

SEQ ID NO: 4193342 - RNA, 60 nt, Human
cugucuagaagcuuugugaaggcagaagcgaucucuccuuugccacccagagccugacag

SEQ ID NO: 4193343 - RNA, 79 nt, Human
cugucucacaguucuggaggauagaagucugagauuaagguguuggcagaguugguuccuccugagggcugugagggag

SEQ ID NO: 4193344 - RNA, 72 nt, Human
cugucucaggaugagaagauuggaaucuucauuugcaaagagaagaaauaagacuucucuguccuuagccgg

SEQ ID NO: 4193345 - RNA, 83 nt, Human
cugucucugacccccacuuugcagcugaggacauuucagguucaaagacaugaacugacuugcucaaggucacauagagagag

SEQ ID NO: 4193346 - RNA, 124 nt, Human
cugucucugacuuugucuuuucuuccucuugacauguucuccugggcauuccugcugcuuacugcaaugucaaucucagagaacacagagcugcgagaguugugaaaucuuagagucagaauag

SEQ ID NO: 4193347 - RNA, 128 nt, Human
cugucucugucuaggagaacagcuauggugcagaauggaagcaucaacauauguguuaagcacauguguauuacccuuucauuccugucucacguagaagguaaaucacuucuucuagacggcaacag

SEQ ID NO: 4193348 - RNA, 64 nt, Human
cugucucugucucuguucgucucccucucuggcaccuguccaggaaugacugcagauggggcag

SEQ ID NO: 4193349 - RNA, 58 nt, Human
cugucugcaggauaguacccucaugaauuucaauguguggggaagucacugcagucag

SEQ ID NO: 4193350 - RNA, 56 nt, Human
cugucugcauuggaagucuggcugggaaacaaguccugagacuuugaguuagaggg

SEQ ID NO: 4193351 - RNA, 61 nt, Human
cugucuggcuuuauauuugcuauuccacaggggugucaaaagcaaucugagggccggcuag

SEQ ID NO: 4193352 - RNA, 79 nt, Human
cugucuuaagaaaaugagcuucccacuacauacauguacuuaaaugcacugagguuguaguaggaauuccuugagagag

SEQ ID NO: 4193353 - RNA, 66 nt, Human
cuuuauaaaggcaguaaaaucuaccuugcagaguuguuguaaggauuagaauuacuguauaugaag

SEQ ID NO: 4193354 - RNA, 66 nt, Human
gacauaaggggagccagccauccagaaccugggcagagacccauguccucugacuugccuugcguc

SEQ ID NO: 4193355 - RNA, 66 nt, Human
gacauaccagaccagcugcguugcuuuccauugacaggaagcaaaucagcugcucaggaaaagguc

SEQ ID NO: 4193356 - RNA, 84 nt, Human
gacauauuuuuacagcugagagacaaugagucauugcaaccuuucugcaugaguuucaaguuuucucaaaaucaaaaaucuguu

SEQ ID NO: 4193357 - RNA, 73 nt, Human
gacaucaccacagcuuugcaccaggugugcggccaccacuagcugagcuuuugccccugcagcuggguggguc

SEQ ID NO: 4193358 - RNA, 71 nt, Human
gacaucaggggaccagcccugcccugcccaugaaccacuuccaaccagcaagcagacugggccccuguguu

SEQ ID NO: 4193359 - RNA, 58 nt, Human
gacaucauagggugggaggaaagguuggguuuucucacuuucuccugucuuaaauguu

SEQ ID NO: 4193360 - RNA, 59 nt, Human
gacaucuacaugcuugccacugcuaggacauuagucagagugaguggguaagugaaguc

SEQ ID NO: 4193361 - RNA, 70 nt, Human
gacaucucuuuugucuuuuuacaccgugcucuuuaacaaagaacauaaacagaaggacagaagaauuguc

SEQ ID NO: 4193362 - RNA, 90 nt, Human
gacaucuuaaugauaauauagaauguauuauaguacagauuccaaaauccuaggauacucuguugugaaacauuguauuuaauagauguu

SEQ ID NO: 4193363 - RNA, 88 nt, Human
gacaucuuggagcucugugggggaaauccuggguugcaaaaacaaauaagggugcaguccuagcccccaggaagcucacuugggaguc

SEQ ID NO: 4193364 - RNA, 85 nt, Human
gacaugagaguguggaacugaauugaucuaacccaguaacugaauuacaaauggguuaagccucauucauagcagucuacguguc

SEQ ID NO: 4193365 - RNA, 63 nt, Human
gacaugauggaaaaaaaugcucugcuguuuucuuguugcuuuucaugguuuuagcaucauguu

SEQ ID NO: 4193366 - RNA, 62 nt, Human
gacaugcauagcuuuggagcuaggaugccagccuaugccuuccugugccagucuauguguuc

SEQ ID NO: 4193367 - RNA, 64 nt, Human
gacaugcgagaccugaaagacccagagauacagauuccuuuucugggccacuugucugcacuuc

SEQ ID NO: 4193368 - RNA, 57 nt, Human
gacauggucccuguugucucugcacuuacagccuggaaacuagcagcaaccaugauc

SEQ ID NO: 4193369 - RNA, 100 nt, Human
gacauguuuuauuauggcagaaucugaaaguauggagcaguaugacguauuaaauaucugcagcaccauauguuuagaucucuucaucuugauaaauguc

SEQ ID NO: 4193370 - RNA, 85 nt, Human
gacauuauguuucagauacagaucaaauuagggcugguuuguguaaauguuuugcuuuauuugcuguaaucugaagcacaauuuu

SEQ ID NO: 4193371 - RNA, 66 nt, Human
gacauuauuauuuuuccuacuuuacagaugaggaaacugauccacagagaggaagaauaguuuguc

SEQ ID NO: 4193372 - RNA, 58 nt, Human
gacauucauugaugucuuccucuguaccaggccaguacuaggaggaaaaaaaugaguc

SEQ ID NO: 4193373 - RNA, 67 nt, Human
gacauucugggcuuggcuguuuccauuauuuuacugacaaugaaaaguggucaaguuccaggaaguc

SEQ ID NO: 4193374 - RNA, 66 nt, Human
gacauugaaaauaauguguagagcuuucuaaauaaaauaagacuuuaugaguuuguuuucuguguu

SEQ ID NO: 4193375 - RNA, 79 nt, Human
gacauuuauuaucucacaggucgagcugucuggaaacaggaaguucuaggcuugguuaauucugugugaugaaguuguc

SEQ ID NO: 4193376 - RNA, 87 nt, Human
gacauuuauuuucagacauuaagugaugggaaguaguaguaaggauuugucauguagcauuuuaugucugcaaagugcuuuacgguc

SEQ ID NO: 4193377 - RNA, 72 nt, Human
gacauuuguucacacugcagggcccugaaaagacagacuggggggcugcuggagcuuugcagaagggguguc

SEQ ID NO: 4193378 - RNA, 62 nt, Human
gacauuuugcuggauugcaucuauacagcacuccacuguaaauggcaacuucacaaacuguc

SEQ ID NO: 4193379 - RNA, 64 nt, Human
gacauuuuugaggucauagggaagggauuuauaguuccccagaagucucuaaccucaagagguu

SEQ ID NO: 4193380 - RNA, 74 nt, Human
gaccaaauggugagaugcagcaacagacauggaacacgugagggccagugucucagcugugcuucauugggguu

SEQ ID NO: 4193381 - RNA, 82 nt, Human
gaccaagcaucuggauggaaagcaaggaauauggucagcaaaguucugccaucugaauuuuccuuuucauucagauguuguc

SEQ ID NO: 4193382 - RNA, 116 nt, Human
gaccaauaaauaaacuaauaagcuggggauugccuauuuugaagauuuuugccagugaauacaauagauucacaggcuuuuacagucagucaaacucagcuuauagacuugugguc

SEQ ID NO: 4193383 - RNA, 80 nt, Human
gaccacaaaguaucaacucccacacugugccaauacugugguaaacacuaugacaguggggaucagguauuuuauguguu

SEQ ID NO: 4193384 - RNA, 62 nt, Human
gaccacacuuugacaaccuugaguacuugaguuuucaagccaccuucaagccagaggugguc

SEQ ID NO: 4193385 - RNA, 80 nt, Human
gaccacagauaguauaauuucauucauaugaaauauccagaauagguaaauucauagaaauggaaaguauauuagugguu

SEQ ID NO: 4193386 - RNA, 64 nt, Human
gaccacagccagguaaaggcauggcaggcacuuggccuccaagcucuacguccugugcuuuguc

SEQ ID NO: 4193387 - RNA, 99 nt, Human
gaccacaguguuggguacgugacaugggcugacccagucguggcacaccauuucccuguccacacugaucgguucacuuauggguacuugacgcaaguc

SEQ ID NO: 4193388 - RNA, 66 nt, Human
gaccacucaguacuaauugaacaccugguacaugcccaugcuugaugugagaagaguacugagguc

SEQ ID NO: 4193389 - RNA, 58 nt, Human
gaccacugaugacaugaggagaggcaaagagggaccagaauucaugucagaaaggguc

SEQ ID NO: 4193390 - RNA, 57 nt, Human
gaccagagacccaguggggaguuaccgucugaaccucuccagccacuuccgcugguc

SEQ ID NO: 4193391 - RNA, 76 nt, Human
gaccagaggccagacugccuuuuaugacuuggccuuggaagucauacaagaucacuuuggccauguucaacugguc

SEQ ID NO: 4193392 - RNA, 67 nt, Human
gaccaggacaguggugugaugacagaagacucagucagauauucuucuuguucagacuauucugguc

SEQ ID NO: 4193393 - RNA, 58 nt, Human
gaccaggcccaggugcaagggacauacacaugacgucccugcgcucaggcucuguguc

SEQ ID NO: 4193394 - RNA, 59 nt, Human
gaccaggcuagagugcaguggcacgaucuuggcuugcugcacccucugccuccgggguu

SEQ ID NO: 4193395 - RNA, 71 nt, Human
gaccagggucaggcuagcccagacuucagguacgggcugugaugacgaggagugggcuagucucccggguc

SEQ ID NO: 4193396 - RNA, 57 nt, Human
gaccaggguugagucagcugcgucagugggagccacacggggcuuguggccaugguc

SEQ ID NO: 4193397 - RNA, 67 nt, Human
gaccaguugcuuggaguaugagcuuccuggagggcaccuccagagagguuucuccaugcugaugauc

SEQ ID NO: 4193398 - RNA, 87 nt, Human
gaccauagcaguagggaaaugugggcuguuucuguagcuauucuuguaaagguuacagagcaucucauuucagaauuugcaguguuc

SEQ ID NO: 4193399 - RNA, 75 nt, Human
gaccauccauucaaugagcccaagaacgugaaaguaaaucuuuauucacaaaagcuuuugaauuuggggaugguu

SEQ ID NO: 4193400 - RNA, 59 nt, Human
gaccauggagaggguauuggcugccuugaccagaaauuuaccaggaccuuuccaggguc

SEQ ID NO: 4193401 - RNA, 79 nt, Human
gaccauuugugcugaaauagaggagguggcugucaagaauaggagucggggucucuauuugcaguggucucaacugguc

SEQ ID NO: 4193402 - RNA, 122 nt, Human
gacccacccaaauaaugaauacauguccuagacauagaaaauucauacauuuuuauuaaugcaccauaggaaugcuauuauuucuguguguggauuccuauguucuuauuaauacauacguc

SEQ ID NO: 4193403 - RNA, 59 nt, Human
gacccagccucugaaaugaacgccccucuauuuuguucuccuggagugcuuguuggguc

SEQ ID NO: 4193404 - RNA, 56 nt, Human
gacccaggaagcuacuucugguaacaguugucacauaccaggcaguggacuggguc

SEQ ID NO: 4193405 - RNA, 55 nt, Human
gacccauauaggacccuccaaagacauuacaugucccagggcucucugcuggguu

SEQ ID NO: 4193406 - RNA, 88 nt, Human
gacccaugccagcagcagagcugggcagaggagccaggcaucauccucucucuccccacacccucugcaugcacuuggccucccuguc

SEQ ID NO: 4193407 - RNA, 64 nt, Human
gaccccaacccuagagucugaccagagacaccaacuguugagccucagccucagggcugggcuc

SEQ ID NO: 4193408 - RNA, 67 nt, Human
gaccccagagggcugaggauaugaacagugaucugguuuuguucuguucuuuguccccuugguuguc

SEQ ID NO: 4193409 - RNA, 55 nt, Human
gaccccagucugcacuccuucccccuccgugggggaagcucuguggcuuggaguc

SEQ ID NO: 4193410 - RNA, 82 nt, Human
gaccccgcccgcuugcuugcuugcuugccugccacucaagagaaggugccaggggacgcggagcgacgagaggcgugcaguc

SEQ ID NO: 4193411 - RNA, 75 nt, Human
gaccccuucccucagcugccgccaagcugcucgguccuuccgaggaagcuaaggccgcguugggguaaggcccuc

SEQ ID NO: 4193412 - RNA, 61 nt, Human
gacccuccugucuucuaaccaaaccaaaaauuaauuagugaagaagagagacaggaggguc

SEQ ID NO: 4193413 - RNA, 94 nt, Human
gacccucuacugguaacuugguugcuaaaggauuuuguauuuauuucugucaacguaagauaauuucugauuuagcuaccucccauaugggguu

SEQ ID NO: 4193414 - RNA, 60 nt, Human
gacccugaaagaggaaugaauuagcucuucaagggccugcucaguccucuuucuuugguc

SEQ ID NO: 4193415 - RNA, 58 nt, Human
gacccugaggauucccugcugauccaugucuuccgauggggaggguguccucaguguc

SEQ ID NO: 4193416 - RNA, 80 nt, Human
gacccugauucugugaaaucacccagguuuaagcgcuagcauuuguuaauccagcgggugauugcacaggcuuuggaguu

SEQ ID NO: 4193417 - RNA, 81 nt, Human
gacccugggaucagccaggcccguucccuucuccagccagagaacuggaggcuggagaaggggagaggccuuccccagguc

SEQ ID NO: 4193418 - RNA, 120 nt, Human
gacccugucacccaaaggcugcaggcagugucuggaguggaggugccuugggcugacagcccagccuggcccugucccccacucagugcagccugccccggugcccccaguggcaggguc

SEQ ID NO: 4193419 - RNA, 66 nt, Human
gacccuguggcugccacuugggugaaguuuggaauaaaccucacuugagauguaccacaaacuguc

SEQ ID NO: 4193420 - RNA, 77 nt, Human
gacccuuggugaaauucaaauaagauauguagauuaguuaauagucuuguaucaauguugaguuccuaguuuggguc

SEQ ID NO: 4193421 - RNA, 56 nt, Human
gacccuuucugagugagcaguucaccugcugugugcagccaccuuggagaggcguc

SEQ ID NO: 4193422 - RNA, 65 nt, Human
gaccgagacuggacucugaagauggguggccuggccagucccgaacaguguccaggcauuugguc

SEQ ID NO: 4193423 - RNA, 77 nt, Human
gaccgaugcaguaaacacuagcauucuuggaauugcagguuaucauuuuccaagcugcugcuguugauucuuccuuc

SEQ ID NO: 4193424 - RNA, 58 nt, Human
gaccuacaguuaauuaguuggagauguugaagcugcuuugacaguacucuguaggauc

SEQ ID NO: 4193425 - RNA, 57 nt, Human
gaauagcaucauuaccuuggauguccuggcucugacauccguugugcuguugcucuc

SEQ ID NO: 4193426 - RNA, 71 nt, Human
gaauagcuucuccagguguaagaauccuucagcuuccaaagcuaaggaacucuguaacaccaguguuauuc

SEQ ID NO: 4193427 - RNA, 73 nt, Human
gaauaggccagcaguauauagcuaauucacucauaauuaaggaaguuagccaagauauucugagucauuauuc

SEQ ID NO: 4193428 - RNA, 81 nt, Human
gaauagggaccuuagaauuguauguauguuucuaggcuaauauuugcaagacaugucuaagguuuaaaguuuuuccuauuc

SEQ ID NO: 4193429 - RNA, 129 nt, Human
gaauaggggaggcaacagagcagagaugacuggauggcccagacucagacugguggacuaccagucuaccaugguauccugagugacugcacaggccaaugauuugacugcuaagaggguuuccuguuc

SEQ ID NO: 4193430 - RNA, 85 nt, Human
cuuucagcccuagcagaaggccagggaugccagcucggcugagcacagccaugcauggcacuggacuggggcugggggauggaag

SEQ ID NO: 4193431 - RNA, 74 nt, Human
cuuucagcucugagugagacuagauuuaggaaacuuacguguuccccaccuaaaggcagccacugagcucaagg

SEQ ID NO: 4193432 - RNA, 66 nt, Human
cuuucaggacaggccuuccacaggcugcugacagcacugcagggaugugaggcccguuccugggag

SEQ ID NO: 4193433 - RNA, 83 nt, Human
cuuucaguacaugacuacuuggaauguuuuaaccuuuccuuuaaugagccauuaagauagaacccaguagucuuuguugaagg

SEQ ID NO: 4193434 - RNA, 60 nt, Human
cuuucagugaaaugccugacaguuuuauguguuccuuccuguuuagcauggcagugaaag

SEQ ID NO: 4193435 - RNA, 63 nt, Human
cuuucauccgcagaugagccuccucaaagguugcgagaggcugaugcuggcugaggcuggagg

SEQ ID NO: 4193436 - RNA, 118 nt, Human
cuuucaucgucuucuaaugaccaaacacuuuguucuagagcuauuuagagcauuuuagguuuuccccuaacaucuuuagcagcucgaacuuggaagaagucauuacgaaugaugagag

SEQ ID NO: 4193437 - RNA, 72 nt, Human
cuuucaugacuuuguggcaaaauaauagauuuugguuuugguuuuguuuuguuuugcuaaagggucaucaag

SEQ ID NO: 4193438 - RNA, 58 nt, Human
cuuucaugcacuucuuuagaucuccaauguuaacccaggucugugcaguguuugagag

SEQ ID NO: 4193439 - RNA, 69 nt, Human
cuuucauuguugugagaucaagcaguugcacuucaagugcauucacugauauaauuuccagcaggagag

SEQ ID NO: 4193440 - RNA, 78 nt, Human
cuuuccaaggucuguuggccuucucugacuccucagccccauuugaggaauguuuugagugccgagagccugggagag

SEQ ID NO: 4193441 - RNA, 79 nt, Human
cuuuccacuggcaaugaggccuuuugaagacuggcaauuuccugaucaguugguucacuccuucaugcccagucagaag

SEQ ID NO: 4193442 - RNA, 68 nt, Human
cuuuccaggaacuaagcacauuaucugauaauuguaaauuuuuuugucagugcuuuaguucaggaugg

SEQ ID NO: 4193443 - RNA, 63 nt, Human
cuuuccccaguaacauacaugugaugucagacagucacaucacagcuauguuacuggggaaag

SEQ ID NO: 4193444 - RNA, 78 nt, Human
cuuucccuuaacagugugacaggaaggcggcaacaucuguuuccaugugaguacacugugauacauugaaagggacag

SEQ ID NO: 4193445 - RNA, 60 nt, Human
cuuucccuuaauaaucuucaaaauguccacgugaaggacaggaagauguuuaaugggaag

SEQ ID NO: 4193446 - RNA, 60 nt, Human
cuuucccuuagccccauucuaucugucucacagaguuuugaguccuggcuaggguggcag

SEQ ID NO: 4193447 - RNA, 89 nt, Human
cuuuccuacugccagauucuucuaauaugaucguguucaaacccagcauggcauuauuggaaggacugcugacuuuggaauugggcagg

SEQ ID NO: 4193448 - RNA, 62 nt, Human
cuuuccuagacuuugcauagaucuugacuuacaaacugcugagcaaggcacagugaggaggg

SEQ ID NO: 4193449 - RNA, 64 nt, Human
cuuuccuuaguugcaauguuugggauaugcuuuggcacuaaaucacagcauucgcaauggacag

SEQ ID NO: 4193450 - RNA, 62 nt, Human
cuuucgccucugggccauguugucagcgaaguacuuaagcacaggggcuccgaaggugaggg

SEQ ID NO: 4193451 - RNA, 67 nt, Human
cuuucuaaggaauagugcuaugaaaaacuuaauuaguguuuuauguagccacugauucuuuugauag

SEQ ID NO: 4193452 - RNA, 69 nt, Human
cuuucuacaggucaguaagaccuagacagaagaauguuuguguuuacuaaacuuguaaguaagagaaag

SEQ ID NO: 4193453 - RNA, 71 nt, Human
cuuucuauucccuuaaaggcagaaccucagagccucaaguggggccaugaggcugccuugggaagagggag

SEQ ID NO: 4193454 - RNA, 57 nt, Human
cuuucucaguguuaauuacuuugaucuucacaacaauccuguauuacacugagagag

SEQ ID NO: 4193455 - RNA, 84 nt, Human
cuuucuccguuuuucacauuucuuuauguagucuuuuguuaagaggacuucuaagcuaagaaguuguagagauaacugagaggg

SEQ ID NO: 4193456 - RNA, 63 nt, Human
cuuucuccucucuuaccugguacaauggauuaucauuucuuguuggagguggggaggggagag

SEQ ID NO: 4193457 - RNA, 62 nt, Human
cuuucuccucuuauucaucccucucucuugcuaaugaucaaguuggaaguaggaagaggaag

SEQ ID NO: 4193458 - RNA, 55 nt, Human
cuuucucugucaaauccauuuaaccucucugaaaggucaguggagaaaggggaag

SEQ ID NO: 4193459 - RNA, 55 nt, Human
cuuucucugugugguaaagggcuggcauugggguccgcccuaccuguagaggcag

SEQ ID NO: 4193460 - RNA, 92 nt, Human
cuuucugggugcaaacacuuugcaggaguaugugauaaucaguaugcuuuuaguuauuguuuauccugcaccccguguugcugccuaggaag

SEQ ID NO: 4193461 - RNA, 90 nt, Human
cuuucuguuuuccaacuacagugaguaaguagacagcuuaccuggggaaaaggugguuugcucuaauguaguccuuggaaagacacuagg

SEQ ID NO: 4193462 - RNA, 57 nt, Human
cuuucuuauaccugucagggccagguuggucccaucuugaugcagguggccuggaag

SEQ ID NO: 4193463 - RNA, 78 nt, Human
cuuucuuauuggucugugagcuguugacaugaugaauacucuuaaagaugucaucaacucacagagccaauaagaaag

SEQ ID NO: 4193464 - RNA, 61 nt, Human
cuuucuuguuauuauucaucuacuuuuccuucauguucaggaagaggugauaacaggugag

SEQ ID NO: 4193465 - RNA, 67 nt, Human
cuuucuuucucguaaacuuaguucuagcuguugguugagcaugaucgcuuuuaugagaagcaggaag

SEQ ID NO: 4193466 - RNA, 127 nt, Human
cuuucuuugugaaucagggaagaaacagaaugaaaauaguucuauagcaaucggaaucuuauaucacuaaauucugggagguagaacugaaaagcaacuucuuucuuugaaccugaaaauagaaaag

SEQ ID NO: 4193467 - RNA, 90 nt, Human
cuuugaacagaucccauccagggagcugcucugcugcagagaaaacucggacccagaagcagcuccucuaggaacggauuagcuucaggg

SEQ ID NO: 4193468 - RNA, 63 nt, Human
cuuugaagagccacagugaaauucaagccccauugaaaaggucugaaaauugugcucucauag

SEQ ID NO: 4193469 - RNA, 64 nt, Human
cuuugaagauggaucgccacucucauuuagaugaaauucuuuggagaggaguuuauuuucaaag

SEQ ID NO: 4193470 - RNA, 66 nt, Human
cuuugaaguguauuuuuguacuaacauuugaaugugugucugauguucugagaaauuacuucaaag

SEQ ID NO: 4193471 - RNA, 78 nt, Human
cuuugaaucaccucauguuaaguguuugauaaccagggucuuccuuuguuaagaucagccuuuagcauuuauucagag

SEQ ID NO: 4193472 - RNA, 76 nt, Human
cuuugacaacucaggcaccucauauaagcagaaucguacaguauuugugcuuuuguggcuggcuucuuuuguuuag

SEQ ID NO: 4193473 - RNA, 72 nt, Human
cuuugagggcaauauauuugaaucaggaacaagaacaucuugcuucuaaguauaaauaugaaccuuuuagag

SEQ ID NO: 4193474 - RNA, 92 nt, Human
cuuugauauucaggcauuuaauccaucugauugauuuauagguaucggauuaagguggaguugaaaucauugcuugagaucugacaucaagg

SEQ ID NO: 4193475 - RNA, 76 nt, Human
cuuugauggcuuuauuuuccugguggcuucuuacuucaaaagcuuccagcucucuuugaagcauaaaccaucagag

SEQ ID NO: 4193476 - RNA, 63 nt, Human
cuuugauguccucucuuguuacuuuuacaugcuggcucuaaaagugcaguugaggaaucauag

SEQ ID NO: 4193477 - RNA, 62 nt, Human
cuuugauucagacuuugucggcagaguacaauuaucauguuuucacagggcugauaucagag

SEQ ID NO: 4193478 - RNA, 98 nt, Human
cuuugcaauuuucaucauuuuauuaaccaagaaaccaaggcucagagaggcuaagugauuuccuugguauccaagaacuaguaagugauggagcaaag

SEQ ID NO: 4193479 - RNA, 62 nt, Human
cuuugcagggcaaauggucagauagcaucaggcugcucucugagacaguagccucugcuuag

SEQ ID NO: 4193480 - RNA, 100 nt, Human
cuuugcauaaugccucuaaugugaaagaugcucaaugaauggugguuucaaucccaaccaccauucauagcaucuuccauauuagaggcauuaugcagag

SEQ ID NO: 4193481 - RNA, 61 nt, Human
cuuugcauccagaaaaggguuuuguaccugggucagagauacuuuucuuuggaugcauaag

SEQ ID NO: 4193482 - RNA, 63 nt, Human
cuuugcauuccaugguuuuccuuccaguuuuaaggcuguaugaagggaauucaugagacaaag

SEQ ID NO: 4193483 - RNA, 83 nt, Human
cuuugccacauucauuacauuuguaaggcuuuucucugguaugaauuauccaauguucuauaaagugugaacugugaguaaag

SEQ ID NO: 4193484 - RNA, 58 nt, Human
cuuugccuuuucuugaguaagcugcugauuagcaggcagcuagcuaagaaggccagag

SEQ ID NO: 4193485 - RNA, 78 nt, Human
gaaugguuaucuugggcauuggcuuauauuuuggccuccgauaugggaagaaaacuaguaaugcuucuagaacuauuu

SEQ ID NO: 4193486 - RNA, 71 nt, Human
gaauguaacauccugacaagaaagccagaaagaacauacaguuucuguauuucuaugcaggauuauaccuc

SEQ ID NO: 4193487 - RNA, 55 nt, Human
gaaugucaguugcgggcauuucaaacagaauaggaaagagcccgcugagagguuc

SEQ ID NO: 4193488 - RNA, 66 nt, Human
gaaugugucagcucuuaacccucuggccuugagggccaaggcugcgguagaaggagcuuugcaguc

SEQ ID NO: 4193489 - RNA, 63 nt, Human
gaaugugucagcuguguacaaagaacaauuccuccuuguuuagucagcacagugauauuauuu

SEQ ID NO: 4193490 - RNA, 75 nt, Human
gaauguguuagaucauuucucccggccaaaaacuacugccaauaauagagugcccaauagaauucuaauauauuc

SEQ ID NO: 4193491 - RNA, 56 nt, Human
gaauguucugaggaaucagagaccauucagauaugaucuuuguccuccaggaguuc

SEQ ID NO: 4193492 - RNA, 77 nt, Human
gaauguugucacauggaauugacuagagucagaaucaguagauucaacacuaguauuucuauaagugaauuacauuc

SEQ ID NO: 4193493 - RNA, 62 nt, Human
gaauuacuagugcugauaaaggacagcuucuugaggagagaaggccuucagcucugguuuuc

SEQ ID NO: 4193494 - RNA, 76 nt, Human
gaauuacugauuuuugggcccuaccacaaacucacugaaucagaaucuuggaggugggaguccaggaaucuguuuc

SEQ ID NO: 4193495 - RNA, 111 nt, Human
gaauuaugaccugccaugggcaguauuuuucaguuaggagcuuauaaauaucucaagggccugaagaaaugacuccaaacagaaaacgaauaaacccuacaggaauacuuc

SEQ ID NO: 4193496 - RNA, 85 nt, Human
gaauuauuuugaguuaaaggcaguugaggaaaagccgaugagauuucuacccuuucccaaucugccuaaaaauggaacauaauuu

SEQ ID NO: 4193497 - RNA, 69 nt, Human
gaauucaggaagaaagaugaucuaauguuacaaaacauuaugaagcaucaucuuauuccugugaaauuc

SEQ ID NO: 4193498 - RNA, 66 nt, Human
gaauucaggcauuccuucuccugucuuuugguuaagcugacccaaagacugaggaaagucucuguc

SEQ ID NO: 4193499 - RNA, 55 nt, Human
gaauucaugcagucuugagucuacaaccaaacuguaacucaagucuaaugaaauc

SEQ ID NO: 4193500 - RNA, 73 nt, Human
gaauuccaucuugggaugcuaggaauguauucuccuuuuggagaauacauguuguuucccuggaggauaauuc

SEQ ID NO: 4193501 - RNA, 78 nt, Human
gaauuccugcucucugguagacugacacccuuuuuccaugaagaaguggucugucuuccagaucccuguuuugaauuu

SEQ ID NO: 4193502 - RNA, 89 nt, Human
gaauuccugggguucugaacucaugauaugcuuuuguaucugaagaugaucauccaaaacauauugaguagcacuacgacaggauuuuu

SEQ ID NO: 4193503 - RNA, 87 nt, Human
gaauucuaaagauauuuugagaaauggcagcauuacugggauaugagucccaguugugacuucauuucacaaaacacauuggauuuc

SEQ ID NO: 4193504 - RNA, 69 nt, Human
gaauucugagaggacaagacaaggaccagagaaagcgcuauggaacuucuuuucuuuucuucucuuuuc

SEQ ID NO: 4193505 - RNA, 106 nt, Human
gaauucugaggugaagcuacagcccagccuccuuccaguuuaaauauugacaugguuaaaaagucugcaaaggagguugggagugugguuaaucacaggugaauuc

SEQ ID NO: 4193506 - RNA, 66 nt, Human
gacugugggaaugcugaugggaucuccaagaagacaccuuagagagaugucgccuugcccaggguc

SEQ ID NO: 4193507 - RNA, 67 nt, Human
gacuguuggcucacagaugggaacggcaacugcucuggaagugcugcuccugggguaagccaugguc

SEQ ID NO: 4193508 - RNA, 63 nt, Human
gacuguuuaauacugugaguucuagucagaauuuucuggguuucacaaaaaugcugaacaguu

SEQ ID NO: 4193509 - RNA, 58 nt, Human
gacuuacacacucugcccugcuguugucaauaacaauaaagggguggagggugugguu

SEQ ID NO: 4193510 - RNA, 103 nt, Human
gacuuacagaaggagccagcagggcugauguuauugacgaagagauacuuuagacccuuuauuugucagcagggagcccugcucugugguuccucuaugaguc

SEQ ID NO: 4193511 - RNA, 92 nt, Human
gacuuacugaaaacucaucacuaauguguagcagaaccaggauucuagccaggauauccugacucuaaauauugaauguuccuuuuccgguc

SEQ ID NO: 4193512 - RNA, 79 nt, Human
gacuuagaauucccugucacuuuuucuacccuuacugaucugacuuuacugagaguugaaaagggaggacauuuaaguu

SEQ ID NO: 4193513 - RNA, 61 nt, Human
gacuuaucugagagucagauuuccugaacauuaaaggacacugaagaaucucagauguguu

SEQ ID NO: 4193514 - RNA, 113 nt, Human
gacuucacaucauacuuuuguuuauuucucauaucaauacuguagauguauuaauacaugcuauacauguacauucuguagauggagaaaauaaggccaaggaacaugaaguu

SEQ ID NO: 4193515 - RNA, 109 nt, Human
gacuucaccaagacugcacagcacagguggcuccaaguuagagccugaacucacgguucuugccucuugaagcuggaggcauuuggcugugauagguuggggugguguc

SEQ ID NO: 4193516 - RNA, 69 nt, Human
gacuucagauauuuuuuaaguugcuugcacccuauuaagcaaguaguaauauugugaaauauuggaguc

SEQ ID NO: 4193517 - RNA, 58 nt, Human
gacuucagcuguucuuagaaagcauucugcauaguuauccagagcagccacugaaguu

SEQ ID NO: 4193518 - RNA, 57 nt, Human
gacuucauauggacagcaaacuagucaaggcucaguggaucauguccuugucaaguu

SEQ ID NO: 4193519 - RNA, 116 nt, Human
gacuucauuuuccuggaaggaauuuugaugaucuauaguuuccuacauuucuauuguaggaugaaacugaaaucaaucagugauucagagacauguccagugccucuuauggaguc

SEQ ID NO: 4193520 - RNA, 127 nt, Human
gacuucuauaguuucuaaggcaucuucuauuuguaaaucaguuuaaaugggcuguuggguagacaauugcucuaauacccaaugagcugaaauaaucaacauggagcccaaggaugcuaaggauuuc

SEQ ID NO: 4193521 - RNA, 67 nt, Human
gacuucugaacuuuuuguuugaauuuucaucauauuugauucugaagcacagaaugguuuaggaguu

SEQ ID NO: 4193522 - RNA, 100 nt, Human
gacuucugcuuccagcucagagucaagcuggugcaucuuacacugcuuuggacagaggcagugugaugcuuccagccacuuucauuuggaggugagaguc

SEQ ID NO: 4193523 - RNA, 129 nt, Human
gacuucuuuuggaaaacauuuaucuuggacauuagucuacagugguucuuaucaacuacuguuuucauuauuguggaaauuagucgguuuaggaauuugggccaaugucaugaauaaugaaaggaguuc

SEQ ID NO: 4193524 - RNA, 89 nt, Human
gacuugacuggaucacagucuggauuguaaucuaaaacauuauaccuagaaauaaugacagcccucuagucugggaauucagucuaguc

SEQ ID NO: 4193525 - RNA, 127 nt, Human
gacuugagcaagguaaccagggcacagcauguugaggaggcacucacugucaggguuguagaaguucaguguuagcacuugagagugagugcuuucuuaaguuuugugcccuggcugucucacuguc

SEQ ID NO: 4193526 - RNA, 121 nt, Human
gacuugcucaccaggcaaauuuuauaguuagcaauguuguguuggcauucuauguuaaguauggaaugcuggugauaauauucuaaaaagugaaauugggcaucucugguggauuuaaguc

SEQ ID NO: 4193527 - RNA, 94 nt, Human
gacuuggagcuccacaaagcaauuacaaaagggauaaguuguauccagcaaacuugucuaacaaaguuguuuugaaguuuaaauaauauagguc

SEQ ID NO: 4193528 - RNA, 66 nt, Human
gacuugggagucuucugagauggguuccuaccaccucacucucccaauccaguuagcugccaaguc

SEQ ID NO: 4193529 - RNA, 55 nt, Human
gacuugggggaagauguggcuguguuaacgacagaaaucaucuccaccccauguc

SEQ ID NO: 4193530 - RNA, 68 nt, Human
gacuuggugccauugcuccuuugcccaccgcucccugaugcccagcagaggugucagugcccaguguc

SEQ ID NO: 4193531 - RNA, 79 nt, Human
gacuugucugaagcugauuaauaucaccaccauugguuagucccaauucuguagaguugauuaauucaucugguaaguc

SEQ ID NO: 4193532 - RNA, 107 nt, Human
gacuuuaaaacuugaggaaaauggacguguguuuuggagucaaauggaccugugcucguaugccagcuuugugacuucggacaagcuauuuaccuucccugaauguc

SEQ ID NO: 4193533 - RNA, 69 nt, Human
gacuuuaaccagcuaacauguggaaugauguacuucauucccucauuguucacuggccccaguagaguc

SEQ ID NO: 4193534 - RNA, 130 nt, Human
gacuuuaccuauuuugggccaaaggugcagucccauacagaagggaaaugccugggagaggcucucaaaguccaggcaucucucugcuucugagcuauucgauugcuuguguuccuaaaauuaguaaagc

SEQ ID NO: 4193535 - RNA, 59 nt, Human
gacuuuauaaaugagaggcggacugcauaucauuccuuuucugcuuauauuaugaaguc

SEQ ID NO: 4193536 - RNA, 63 nt, Human
cuucugaguagccacagagcgaaaggagcacauuacaccuuccucaugggguuccuucagaag

SEQ ID NO: 4193537 - RNA, 55 nt, Human
cuucugcaauaaguuuugguccaugcguuuauuggacccuaaucaucugcaggag

SEQ ID NO: 4193538 - RNA, 65 nt, Human
cuucugcaugcccucuguguggcugacaguucugggggcccaggagguugggcugugcagcuuag

SEQ ID NO: 4193539 - RNA, 77 nt, Human
cuucugccugccuccuuccccaagucgucuaggccacagacuucaggcuuagacauggagaaggagccagugggaag

SEQ ID NO: 4193540 - RNA, 64 nt, Human
cuucugcggguccuccaugugaugauguccaauugggcagcacacgguggugcccuggcagggg

SEQ ID NO: 4193541 - RNA, 55 nt, Human
cuucugcugucuuuucuccauccugcagccuggaacucagauaugauagcaggag

SEQ ID NO: 4193542 - RNA, 120 nt, Human
cuucuggaaauagauuguggugacaguuacacaccauugugaacauaauuaguaccacugaacuguacacguuaaaaugguuguauguuauauauauuuuaccauaauaaaaacuagggg

SEQ ID NO: 4193543 - RNA, 77 nt, Human
cuucuggaagagcuguucagaaauguuuauugaucaaauaaauaaauagaaucuaaacugcucaucuuaaaaagagg

SEQ ID NO: 4193544 - RNA, 83 nt, Human
cuucuggccugcccauccugccugccaaugaugcuuguguggccauagaaaggucuuuggcagacaggugcagaugccaguag

SEQ ID NO: 4193545 - RNA, 105 nt, Human
cuucuguaucuauggaguuaggguuacaccagccuccuggcaugaagauguguuuuucaacucagagcuguccaaacccugacacuuaagggguuuuuauggagg

SEQ ID NO: 4193546 - RNA, 64 nt, Human
cuucuguauuucuucagguucuucuaggaaaugguucuucugguuuuacugaggaaaucagucg

SEQ ID NO: 4193547 - RNA, 72 nt, Human
cuucugugagguaccugggaucgucaaacucagagacagaguagaaaggagguuuccaggugcuguggggag

SEQ ID NO: 4193548 - RNA, 71 nt, Human
cuucugugcaauuguggaggagacaccaaagcaucugaaauuggagcccuuccuugacaguugggugggag

SEQ ID NO: 4193549 - RNA, 119 nt, Human
cuucugugcccccaauccgcaaucuccuuccccaguuccaggggccugcugggauuggcugcaguggaagaggcucuuugagcugggagaaggguuuaugcagaaaguggggcuagaag

SEQ ID NO: 4193550 - RNA, 64 nt, Human
cuucuguguuuuaaacaguagaaagaauagagaaauacugguuuaauggguagaacacagggug

SEQ ID NO: 4193551 - RNA, 119 nt, Human
cuucuguuucucacgcaugauuaccuuguugcuguacacugccugugugugccugcagaaaguacauaauagauuuugcagauaggagguacaaagaggguguagugugagaacaaagg

SEQ ID NO: 4193552 - RNA, 65 nt, Human
cuucuuaaugacagauuaaaauaguugucaaggcucugauggggugaaacucugucauuaagaag

SEQ ID NO: 4193553 - RNA, 73 nt, Human
cuucuuacuucuguauuuuauaauuuagaguuuagacacauuuuggauuacaugaaaugcagaagaggagagg

SEQ ID NO: 4193554 - RNA, 119 nt, Human
cuucuuagcacuuuuauucuuugcuuccaaaguagaaucuucaacucagagagugcugcugaugagucgauaguacucauuuugggcugggugggggaggagagugaaaugucuaggag

SEQ ID NO: 4193555 - RNA, 130 nt, Human
cuucuuauaaauccguccucgcuguagcagauuccaguuaagcuguccaugauuuucugcacuauggaaguauuauuuaacaaauuuguguccacaguggauuaaaguuacuggacuggguuuggagaag

SEQ ID NO: 4193556 - RNA, 73 nt, Human
cuucuuaucuuacuugaaauuccaagcaggagaccuccuccucugggcuggaaaauuaauguuuuauaagagg

SEQ ID NO: 4193557 - RNA, 79 nt, Human
cuucuucaccacuuugcaccaggccuaggguugcccccauuaguuacucuuuugggucauggucccaaagggagagaag

SEQ ID NO: 4193558 - RNA, 65 nt, Human
cuucuucauuucagucugagauaagaaaaaggaagauggcauuucaggcagguggaaugaguagg

SEQ ID NO: 4193559 - RNA, 73 nt, Human
cuucuucguggauggcuguuccugggaguucuagcuccucacuagaugcucaugagucagccaguaugagagg

SEQ ID NO: 4193560 - RNA, 60 nt, Human
cuucuucucugucuccuuuuucuucccuuuggaauaaaugcacagaggccagagaggagg

SEQ ID NO: 4193561 - RNA, 56 nt, Human
cuucuugagcagcagaagaggauuggguuacugcccauuucugcagcucagagaag

SEQ ID NO: 4193562 - RNA, 75 nt, Human
cuucuugcaaaugugaauaauuacaccugauaucuccaggcacugaaauuauaugcauuugaaugauuuaggaug

SEQ ID NO: 4193563 - RNA, 97 nt, Human
cuucuugggcccuuucuugggugacucagcuggaagggggaugccagaaucuucauauaccuugcguuucacaguggccuuuaucugggcccugaag

SEQ ID NO: 4193564 - RNA, 87 nt, Human
cuucuuguaauuacaucuaaaauaagccuuauaaugauuggguguuauaaugauuguuacuggguuaauuuggacuugaaagagaag

SEQ ID NO: 4193565 - RNA, 65 nt, Human
cuucuuucuauugaucuaauaaacaucacauagcacagugaugguugaagaccaguggaaaagag

SEQ ID NO: 4193566 - RNA, 63 nt, Human
cuucuuuggggaauauucugguuguuauuuucacuuucuuagcaacgagguaaucuaaggagg

SEQ ID NO: 4193567 - RNA, 84 nt, Human
cuugaaaugucgcuagcuuuguccauugucuugcuuguucacuaagacuguaauaaaugcuugagguuugugauugauuuuuag

SEQ ID NO: 4193568 - RNA, 130 nt, Human
cuugaaauuuuguggaaucaacuauaaccacguccaaaaaugcuagugaugagaauauauuugaauagaaauucaagaauuuuuaaugugacugauguuaagugacugguaauaaagaauucuauuuaag

SEQ ID NO: 4193569 - RNA, 73 nt, Human
cuugaacacugacauuuuccugacugccaugcacgugauauauuucuuuggcaucugaaagguuaguguugag

SEQ ID NO: 4193570 - RNA, 69 nt, Human
cuugaacccagaaguuggagguugcagugagccgauauugugccauugcacuccagccugggccacaag

SEQ ID NO: 4193571 - RNA, 69 nt, Human
cuugaacccaggaggcggagguuguggugagccaagaucgcaccauugcacuccagccugggcaacaag

SEQ ID NO: 4193572 - RNA, 65 nt, Human
cuugaacguggccaugcacagaaaaaucccaauuugggaugcaucucccacagccgugcuucaag

SEQ ID NO: 4193573 - RNA, 67 nt, Human
cuugaacucaaugugaggaagaauguaguacuguuugcaacucccuuccgucauuuaguuauucaag

SEQ ID NO: 4193574 - RNA, 129 nt, Human
cuugaagcuuugcaauauguugggaugguucuguagggucuuuggugucccuugggucaggaagaucucaggcccagcccgaaucccuaaagcaauugacaucagaauagagguaaagaaguuaucagg

SEQ ID NO: 4193575 - RNA, 114 nt, Human
gaaauuaucuuacuuguugaaguggccucuuuuggaaaaagccugaacauaguuugucuauugugaucuguucuuuuuccugaagaaaauauuuucuuuuuaguuuuuaauuuu

SEQ ID NO: 4193576 - RNA, 94 nt, Human
gaaauuccaacgaaguagugauucuguuguuuuauacaucuuuuugccaaacaucaagaaugauuacaaagcaacgaaugauacauuguauuuc

SEQ ID NO: 4193577 - RNA, 68 nt, Human
gaaauugcugacaccaaguaguagccagcuccacuggaaucugcuaucuuguuguuaaaagagcguuc

SEQ ID NO: 4193578 - RNA, 59 nt, Human
gaaauuuacaacuuucucaugggaagaaagagaaaauccuaugaguuaggggaaauuuc

SEQ ID NO: 4193579 - RNA, 92 nt, Human
gaaauuuuuugcuguggcuaaagaaaaugugaaaugagauauuuauaaccauggauaccugguuuuuauuuacagucauaagaaagaaauuc

SEQ ID NO: 4193580 - RNA, 88 nt, Human
gaacaaaaggcaucuuugaucucuggaguaaauuauucaaaaugccauagccuugcaccaaaugaguuaaaauugccuaguuuuguuc

SEQ ID NO: 4193581 - RNA, 58 nt, Human
gaacaaacauuuuuggcaguauguacccauuuagcacacugccuauauauguuaguuc

SEQ ID NO: 4193582 - RNA, 61 nt, Human
gaacaaauguucuuuuuauccaguuguuuuaaaacugugugguuaaaagacacaucuguuu

SEQ ID NO: 4193583 - RNA, 66 nt, Human
gaacaagguugucucuuuauuaucuuggguauuuauacuggagagaccucagaaacaaucuaguuc

SEQ ID NO: 4193584 - RNA, 103 nt, Human
gaacaaguuuaaacugaaacugugaugguuacuaugcuuaauguuuuuguaggcauuucauaaauauuaggcaaggagauuauuuaguacuccugauuuguuc

SEQ ID NO: 4193585 - RNA, 85 nt, Human
gaacacaaggggucuugaguauuucacacuguaaagcauauguguccacauauacauagauuuugaaacuggacugcuuguguuc

SEQ ID NO: 4193586 - RNA, 65 nt, Human
gaacacagugggcuuugcauaggagcucuuaacuaagcuucaguguucccaucuguaaaauguuc

SEQ ID NO: 4193587 - RNA, 60 nt, Human
gaacacauuagucugaguuggcuaauaaauccuacagcccaucucuagcaaauguguauc

SEQ ID NO: 4193588 - RNA, 79 nt, Human
gaacaccagccuucaaggcuuagcucagaaguaacacuugucacauuugguaguuuauaggccauggaggcucauguuu

SEQ ID NO: 4193589 - RNA, 78 nt, Human
gaacacccaugguucaauuaaaaugacuuuuuggaaaaauuggauuucuaagcaaucuguaguuggaaucagguguuc

SEQ ID NO: 4193590 - RNA, 68 nt, Human
gaacacucagggccuuauccugccauugagccucucaaugauaucagcaggauguggcccgaagguuu

SEQ ID NO: 4193591 - RNA, 77 nt, Human
gaacacucauuggacaauuuuuguuuggugggcaaugguccagaaaauucagaaauuguuuuauuuaauucauguuc

SEQ ID NO: 4193592 - RNA, 60 nt, Human
gaacacugcuguuggguucugaguguuugucccucacauaggauuccagcacacugcuuc

SEQ ID NO: 4193593 - RNA, 64 nt, Human
gaacacugugcauuggauuccuggugcuccaccucagagccagcuuccauggccacgucaguuc

SEQ ID NO: 4193594 - RNA, 59 nt, Human
gaacacuucuugugccucuguguccucauuuuuaaguggauauacaagaucaaguguuc

SEQ ID NO: 4193595 - RNA, 57 nt, Human
gaacagaagaggcuggugccacuguaagccuaagaggccccaggccuagauuuguuc

SEQ ID NO: 4193596 - RNA, 70 nt, Human
gaacaggcaaagggugaaggcucauacauuuagauuagccuuuuaaagugguugcugucagccucuguuc

SEQ ID NO: 4193597 - RNA, 107 nt, Human
gaacagggagccuagaggccagaguucagggcagcuagaaccaggaaugagcgcuagagcaguucucaucuagacucugcccuugaaugaccaggacucauuuguuu

SEQ ID NO: 4193598 - RNA, 81 nt, Human
gaacagggcaggcuucagcuguuuaauaaaugucuguugaccucaaccagaucgacuguuaacagcagcaugcuccaguuc

SEQ ID NO: 4193599 - RNA, 55 nt, Human
gaacaguacuaagagcuuuacauguauuaagccaauuagcccuuaaguacuguuc

SEQ ID NO: 4193600 - RNA, 56 nt, Human
gaacaguagaugagaugcuagaauauuuggauauuuuaggaugaauuauacuguuu

SEQ ID NO: 4193601 - RNA, 76 nt, Human
gaacauacuuaucuugccuuuaacugcucaucuucugcaauaggacugagcucccugagggcaggccuuguggcuc

SEQ ID NO: 4193602 - RNA, 76 nt, Human
gaacauagauagcaaacuggcagcuugugggcuaaauacagccuaccgacauguuuuguuugcucucccaauguuu

SEQ ID NO: 4193603 - RNA, 105 nt, Human
gaacaucaggaaguaauguuugacuacaugaccuuaagguuacuucuucugcacuugcaggggucugagcuuguuagggcaguggucgcagaucugacuuuguuc

SEQ ID NO: 4193604 - RNA, 87 nt, Human
gaacauccucaggaagggguggggcaggcugugcugggcagguugcuuuccacagugacacccagucuggcccagccugagguguac

SEQ ID NO: 4193605 - RNA, 82 nt, Human
gaacaugcuugauuuuuacuguggcaaaagaacauuggagggaaaacccucaugauuuuucuuuacaguugaucauuauguc

SEQ ID NO: 4193606 - RNA, 59 nt, Human
gaacauuauuguacaaaugucuuugcauucucuugcaacuauuuuuguaggauaaguuu

SEQ ID NO: 4193607 - RNA, 66 nt, Human
gaacauuugaugaugacauuggcuuagcaccauguaguuauaauccauguucuucauuuaauguuc

SEQ ID NO: 4193608 - RNA, 88 nt, Human
gaaccaauggagaauguuacauuaggauaauuugcuguacccuagauuuguuguaguagcaaauacaugauguaauuucaguggcuuc

SEQ ID NO: 4193609 - RNA, 124 nt, Human
gaaccaccugggaugauuguuaaauauaaagauuuccagccuuuauccauccagacccucgacagcagagccucuggguguagggccuggcaacugguauucagacaagcuccccaggugauuu

SEQ ID NO: 4193610 - RNA, 68 nt, Human
gaaccauaugaaauugcccuguuuguaaguuaaaaaaaccauugaauacaggcaauuucauaugguuc

SEQ ID NO: 4193611 - RNA, 68 nt, Human
gaacccauaucuuguaauagguccacuuguuaaauuccuggcuuauggucuagaacaggauuuuguuc

SEQ ID NO: 4193612 - RNA, 72 nt, Human
gaaccccacugcauuuuggcuaguuaaaguuaauugcauaauuauugcuuugcuggcuugaaaugcugguuc

SEQ ID NO: 4193613 - RNA, 85 nt, Human
gaaccuacuauguaucaggccuagaacacagcagauaugaggaugcuguuguggguuuagcuuugagagaauuggacuuggguuc

SEQ ID NO: 4193614 - RNA, 80 nt, Human
gaaccucuacauccaggaaaggacagagucuucuuuggccugcaaggccccaauucuuuucuuuaccagaaugaggguuu

SEQ ID NO: 4193615 - RNA, 55 nt, Human
gaaccucuauauuugugacauccauuagaggagccacaagacacauaggguguuu

SEQ ID NO: 4193616 - RNA, 64 nt, Human
gaaccuguccugagugaggaguuccuggaggaucuuacacaggccucaucaaagggagagguuu

SEQ ID NO: 4193617 - RNA, 77 nt, Human
gaacggcccagggaaugagugguaccgcgggcgcccggcgcacccagcaggugccaucacucuggaugggccaguuc

SEQ ID NO: 4193618 - RNA, 67 nt, Human
gaacgugcaccaggaggucaugaguauaauaaaaaacgguuuaugaccugcacuggagcauaacuuc

SEQ ID NO: 4193619 - RNA, 55 nt, Human
gaacguggcaggcuuuacuaccaggaacgcacucggugguggaggccccauguuc

SEQ ID NO: 4193620 - RNA, 103 nt, Human
gaacuaacaauugaaaagcaucacacagauggcugccaagaugggcugcuucccagcccaaaaucugcaacccucuaagguggcuacaauuauccugagguuc

SEQ ID NO: 4193621 - RNA, 56 nt, Human
gaacuacaggugcagcaagugaguaaacaguaccagcugcuccuuggcugugguuc

SEQ ID NO: 4193622 - RNA, 61 nt, Human
gaacuagcccacugcaaauguuggcugcaguauucuaaaaagccagcacagggagcaguuc

SEQ ID NO: 4193623 - RNA, 99 nt, Human
gaacuagcggagagugcaugaaucaaagagguaaaaacguucccuccccagggaggcugccagcugucucauugauucagugcugcucuuggcugauuc

SEQ ID NO: 4193624 - RNA, 108 nt, Human
gagaaggcuggacuauguaauaucuauuaugcuauagaacuugcaaucuaauugggaggcaaaucauggaauaacuagagauuacugauaguauuaucaaguucuuuc

SEQ ID NO: 4193625 - RNA, 62 nt, Human
gagaagggaaaugggaacucaaggcaagaaugccucccuggcagcugguccccaagccucuc

SEQ ID NO: 4193626 - RNA, 61 nt, Human
gagaaggggugauguggguaauuuacaacacuccuuuguacuuucucuauuaugucuucuc

SEQ ID NO: 4193627 - RNA, 94 nt, Human
gagaagguaaggacagcuggcuggguggugccugagguccucaagccagguaggggugagguccaggccucaugauggccaucuguuccuuuuc

SEQ ID NO: 4193628 - RNA, 129 nt, Human
gagaaggugccggagugggcaguggaaaguacucuucuggucuggggaccacuagcugaaucccugaggagcucugaggccccacgggggaguccuaguuuccaggugcuucucugagcaguggugcuc

SEQ ID NO: 4193629 - RNA, 71 nt, Human
gagaaggugggcuuguagccaggaugccagcaaucagcaaggacaccugcacagccccagaaugccagcuc

SEQ ID NO: 4193630 - RNA, 81 nt, Human
gagaaguaaugagaccugagaccuaaucugacuguggugcuagcucuaccauggacugagugaggcucauuuaaucuucuc

SEQ ID NO: 4193631 - RNA, 68 nt, Human
gagaaguccuuagccuaggacgguccagccaaacugaugugcugcuguuccggcuacagcccuuacuc

SEQ ID NO: 4193632 - RNA, 78 nt, Human
gagaagugguuguuggcagugcuacagucaguaacagcgcuucugugaacaaggccaagcauucuagcaacaaaccuc

SEQ ID NO: 4193633 - RNA, 77 nt, Human
gagaagugguuguuuccagguuugaaaaauuucacaguauuauuuuaagcuacaagagacauaugccuaacuuccuc

SEQ ID NO: 4193634 - RNA, 78 nt, Human
gagaaguuauuggauuggucacacaauaguauauauacuuaaauuauaugcacuaugaugagcuagucuuaauuucuu

SEQ ID NO: 4193635 - RNA, 82 nt, Human
gagaauaaagaauugagucuaucacuugaaagagagaagagggaaaauuaucucagccaggugaacucaguuuuguauuuuu

SEQ ID NO: 4193636 - RNA, 81 nt, Human
gagaauaaguaacuugugucuuaaagauuaaauggcaaauuugcuauuaaaugugaaagacauaaaauggaauuauugcuu

SEQ ID NO: 4193637 - RNA, 64 nt, Human
gagaauaauggguaagggagguuugggaccauuugggcaccgaugcccucauucacuuauucuc

SEQ ID NO: 4193638 - RNA, 77 nt, Human
gagaauacagaggguuucaugggcagaaauucauuuucucagauggaacaagcugcccugagggccuguguguucuc

SEQ ID NO: 4193639 - RNA, 99 nt, Human
gagaauacugacucuaaaucuuuauacauuuugcugggacuuauuacuuccaacacucuuaggaagucacagaagcuugaagauuuucccgguguuuuc

SEQ ID NO: 4193640 - RNA, 99 nt, Human
gagaauaguuauuggucugagcucaagugacaguuaggaaaucugucuguucccgaggccucaggcugauugucaaggguacaggcagaugauguucuc

SEQ ID NO: 4193641 - RNA, 84 nt, Human
gagaaucacuugcaccuagggggcggagguugcagugagcugagaucaugccacugcacuucagccugggcaacagugagacuc

SEQ ID NO: 4193642 - RNA, 87 nt, Human
gagaaucgcuugaacccgggaggcggagguugcagugagccaagaucgugccacugcgcuccagccugggugacaagagcgaggcuu

SEQ ID NO: 4193643 - RNA, 86 nt, Human
gagaaucgcuugaacccgggaggcggagguugcagugagcugagaucaugccacugcacuccagccuaggugacagagcgagacuc

SEQ ID NO: 4193644 - RNA, 83 nt, Human
gagaaucgcuugaaccugggaggcggaaguugcagugagccgagaucgcgccauugcacuccagccugguaacagcgagacuc

SEQ ID NO: 4193645 - RNA, 78 nt, Human
gagaaucugcauuucuuuaaaaacuuuaaaaauucaagaguuaguuauuuuaagaaguuuuuguagagacagggucuc

SEQ ID NO: 4193646 - RNA, 62 nt, Human
gagaaugcaagaaaugugaagcuacaauauauuguaaaaaauuucgcuuuuuuuguauuguu

SEQ ID NO: 4193647 - RNA, 59 nt, Human
gagaaugcagaguugcugguggcacauuaaggugguaugcugaagaacucuuuauuuuc

SEQ ID NO: 4193648 - RNA, 76 nt, Human
gaagacauuuuaugcauacucugugccugggcauuugacauuugaaagccucccuaaagagaugcuaagagucuuu

SEQ ID NO: 4193649 - RNA, 65 nt, Human
gaagacccuucucugaggaggaagauuaccagugagaauuucuuugcuauagaugauggggauuc

SEQ ID NO: 4193650 - RNA, 65 nt, Human
gaagaccuaagguuuuagcccuuuccuugucacuuaccuuugaaaggucucugagccuugguuuc

SEQ ID NO: 4193651 - RNA, 103 nt, Human
gaagaccuuggagaucuggggcugagccucaagguacagaugaaagucuaguuucccaaaacugggccguguguguucccucaccccacuccaggcuugucuc

SEQ ID NO: 4193652 - RNA, 55 nt, Human
gaagacgagaucugugccuccaguguucgguuuauuagguccaaugcucgucuuc

SEQ ID NO: 4193653 - RNA, 71 nt, Human
gaagagacugggccaaggucagcagcuuuaaguggaaaagcugggaugugaauccagaucuuuuucucuuc

SEQ ID NO: 4193654 - RNA, 83 nt, Human
gaagagacuugguugaugucauaagguuucucagcgguuguaaaguccuuuguuuucagccugugacucagccuguauauuuc

SEQ ID NO: 4193655 - RNA, 61 nt, Human
gaagagagagcccugggguccguggaacugcuugcugcuagacuccaggcaucuuuauuuc

SEQ ID NO: 4193656 - RNA, 58 nt, Human
gaagagauagaacuaugaaaacaacuuagauuuccugguuuccaguucuaaucucuuc

SEQ ID NO: 4193657 - RNA, 89 nt, Human
gaagagcacuguuucugaaaagcuaggccaguucagcugaucauuguuagcuagagauaagcuggcuuugggaaacucugagacucuuc

SEQ ID NO: 4193658 - RNA, 60 nt, Human
gaagagcagugguugaacagaggcaucucauuuuuaugcuucuaggggcuucugcuuguc

SEQ ID NO: 4193659 - RNA, 86 nt, Human
gaagagcuauagguugcugugaccgcugccacaaccauuuggguaucacugcccaaaucaggggccacaagcauuucugccucuuc

SEQ ID NO: 4193660 - RNA, 99 nt, Human
gaagaggacaauaugccugacauaaaucuaaaggaaagggugccaauucuugaucuuuuggcccuuucuuucagacuuuauauuaacauugaacucuuu

SEQ ID NO: 4193661 - RNA, 86 nt, Human
gaagaggagaauaacagagaaggguggcuuccuauagcagagauaaagcuuugggggucgccaaauuucaugccaucuaucacuuc

SEQ ID NO: 4193662 - RNA, 64 nt, Human
gaagaggaguagagaagaccuagauguuggcuuugacucugcugguagcucauuccaugacuuc

SEQ ID NO: 4193663 - RNA, 58 nt, Human
gaagaggcuuuccuagggcaagagccagcugguggccauagcuguaagaagccucuuc

SEQ ID NO: 4193664 - RNA, 71 nt, Human
gaagaggguaggugucagaaagcccaucugagaagagcugcccacucucaggugggcacaccucccuucuc

SEQ ID NO: 4193665 - RNA, 75 nt, Human
gaagagguccuguuuguauuugcuggaacuugccuuucucucggcuucuauggcaugcugcaaacuaucuacuuc

SEQ ID NO: 4193666 - RNA, 64 nt, Human
gaagaguagaagagggaagaguagaaaacauaaauaaugaaagacuuuuccuucuauauguuuc

SEQ ID NO: 4193667 - RNA, 129 nt, Human
gaagauaagucauuuuuuuucugaucuuacacagauaauagcauuaucaucaaaacucaaucauagauguacugauccagugcuguggcuguuaagcccuucaauauaauaagaugauuaauauaaauc

SEQ ID NO: 4193668 - RNA, 85 nt, Human
gaagauaauuccauagagaugcagcaaucaccuuuuuuaaagauuucauuaaaugaagauauucuuguuuucugugguagucuuu

SEQ ID NO: 4193669 - RNA, 86 nt, Human
gaagauacaaaaaacauaacacacauaaagcacuggcgcaaugccugacucagugaguguuuccugaguguuaucauugugucuuc

SEQ ID NO: 4193670 - RNA, 85 nt, Human
gaagauaugccuaugaggcauacuuugaauuaaauauuucagaaggcugaugauagguacaagguuuuucguaggaauguucuuu

SEQ ID NO: 4193671 - RNA, 58 nt, Human
gaagaucucucaguggcuccugugucccuuugacauaggccaauacuguagaguuuuu

SEQ ID NO: 4193672 - RNA, 66 nt, Human
gaagaugaggguuauguuaguagguuuguuuguacagauccauuuuggugucaacucccagucuuu

SEQ ID NO: 4193673 - RNA, 74 nt, Human
gaagaugcauuaagggccuggagauacacuggucaacaagacaaguauggugucuccugccuucaugcagcuuc

SEQ ID NO: 4193674 - RNA, 80 nt, Human
gaagauuaggaaaccaaguuuauuccaaguuaccccaagucuugggguaaaugaauuaaaaacucugggcuucaauuuuc

SEQ ID NO: 4193675 - RNA, 99 nt, Human
gaagauucaagguguaauaaaugaacaaagcagguugccagacaacauuauauuuguaacagaugcuauguauuauguaugccacacuuguguaucuuc

SEQ ID NO: 4193676 - RNA, 79 nt, Human
gaagauuuugacacuggcugggccagcacuccugggugccaucagugcccaacucugguccaggcuagugcccaucuuu

SEQ ID NO: 4193677 - RNA, 111 nt, Human
gaagcaaaacuuugaugugauuuuaauagcauguaaguuuaaaagaccuggagguaaagguuuuagacuuuucuugucuggaaagaaagugacaucgacuuguuugcauuc

SEQ ID NO: 4193678 - RNA, 99 nt, Human
gaagcaaacaacauugacauaaagcuucuguccacagcacugauggcaguaacacagcauuggcaacaguaaagacagaauuuaucucguggcagcuuc

SEQ ID NO: 4193679 - RNA, 64 nt, Human
gaagcaaaugaaccagagguaauacuaagagauggccuugguauugauccauuuuauuuguuuu

SEQ ID NO: 4193680 - RNA, 70 nt, Human
gagagacagcuggggagagacauggcagggucggagcgcggccugcgccucugucacucagcauccucuu

SEQ ID NO: 4193681 - RNA, 81 nt, Human
gagagaccaugguuuguguggcccagaugacagcuuccuaaaacucaccugucauccuuuccauuuagacuuccuuuuuuc

SEQ ID NO: 4193682 - RNA, 92 nt, Human
gagagacgcuuacagacuauuuauuuacagaaagcuaaaagauuucuuuuucaggaguaagaguuuucauguuagauauugugaacccucuc

SEQ ID NO: 4193683 - RNA, 60 nt, Human
gagagagagagagagagcaagccugagaggcucaggcucagugcaaaucauucuguccuc

SEQ ID NO: 4193684 - RNA, 103 nt, Human
gagagagaggggagcaacagcugggugcugcucagagccccuaacugaaauggauagacaggcucaucugggaagaucuaguuuuuguucauuucuuuuucuc

SEQ ID NO: 4193685 - RNA, 60 nt, Human
gagagagaggggcgagcaaacacagguucauuaaucuguaguucgucugccuuuucuguu

SEQ ID NO: 4193686 - RNA, 61 nt, Human
gagagagaucuuuucuguguuuauggauacuugagcaaaaauacagaaggcagacucucuc

SEQ ID NO: 4193687 - RNA, 58 nt, Human
gagagagcucuggcugggugaccuugcucuggcaggguggucagggaggggcuuucuc

SEQ ID NO: 4193688 - RNA, 60 nt, Human
gagagaggcuccccuugccccaugaccaguaacuggggcugaggcaggggugcuuuuguc

SEQ ID NO: 4193689 - RNA, 65 nt, Human
gagagagggaaucuaggcucagagugccagaccaggucugcagggcccaaagauugcucucccuu

SEQ ID NO: 4193690 - RNA, 55 nt, Human
gagagagguaggggcauccuagugaccuuuugucuggaauguaccucccucucuu

SEQ ID NO: 4193691 - RNA, 69 nt, Human
gagagauggaaauguuccauauauugauuaugauuguaguuaguguguuaaugaguauauccauuuguc

SEQ ID NO: 4193692 - RNA, 63 nt, Human
gagagauggccagagagagcacaccugugcuaucgcauaggacaguuuacuuugguuacucuc

SEQ ID NO: 4193693 - RNA, 69 nt, Human
gagagaugugagaaucaagugaccaucagcugguauaaauguuuuuggucaguguagucacaggaucuc

SEQ ID NO: 4193694 - RNA, 56 nt, Human
gagagauucacaaagcuuauuuaaaaagugaacaagaaugaacuuuggugucucuc

SEQ ID NO: 4193695 - RNA, 58 nt, Human
gagagauucauguuuacuguaggcaggcgugccugucuuuacauacugaugaguucuc

SEQ ID NO: 4193696 - RNA, 102 nt, Human
gagagcaacagguguggcuuccaggugggaucaaagagucauucggauaggauuuugaaaaaacaaguuggcccauuugugagagacacaccacagugccuc

SEQ ID NO: 4193697 - RNA, 61 nt, Human
gagagcacaugaacauggaggagagaugaacagcuuccuccaaaagaagagcguggcucuc

SEQ ID NO: 4193698 - RNA, 61 nt, Human
gagagcaggcucuaggaauucaaagaccaagcaggcagagcuggauucuggagcugcccuc

SEQ ID NO: 4193699 - RNA, 80 nt, Human
gagagccgggaguccagagggcugcaggaugcugccaagcuccagccccaccaccgagcagccacuggaaccacggccuc

SEQ ID NO: 4193700 - RNA, 61 nt, Human
gagagcuggaugaaaaggauuccgaacugcuuuucaggacauccaugaaucaucugcuuuc

SEQ ID NO: 4193701 - RNA, 58 nt, Human
gagagcugggcugaaaguguuccuugagguuugccugaguuucucugagccugcucuc

SEQ ID NO: 4193702 - RNA, 56 nt, Human
gagagcuuucgggaggugcugcagugucuggcccgugcuuaccgccccagggcucc

SEQ ID NO: 4193703 - RNA, 68 nt, Human
gagaggacaccauuugccacugucacaacuggcccuguauacugucggguucaguggcagaucuucuc

SEQ ID NO: 4193704 - RNA, 74 nt, Human
gagaggacaggcaggcacuccuaggaccaucauagcagcgacccagcccugguggccagugccccuccccucuu

SEQ ID NO: 4193705 - RNA, 101 nt, Human
gagaggagaaggguuggggagcugguguguccuguccccuugcugcugacagugacugucauacagacaggacucaacucucuguccauuugucucuuuuc

SEQ ID NO: 4193706 - RNA, 96 nt, Human
gagaggagaauugcuuaaacccggagucggagguugcagugagccaagaucgcaccauugcacuccagccugggcgacagagcaagacucugucuc

SEQ ID NO: 4193707 - RNA, 63 nt, Human
gagaggagcucagucucacagggugaggaaaggcuuucuuucuuacacagucuggcacuucuu

SEQ ID NO: 4193708 - RNA, 60 nt, Human
gagaggagguggcuaugacagcuaaaugucaucuuuuacuaucauggccauccucuucuc

SEQ ID NO: 4193709 - RNA, 65 nt, Human
gagaggcaagcaggauuucaggccauuacugacaugagccugaauuugaccugcuuacuccuuuc

SEQ ID NO: 4193710 - RNA, 71 nt, Human
gagaggcagaggccugaaaccgucuagagccauguggggagcuggguguguauucaggccaguugcuuuuc

SEQ ID NO: 4193711 - RNA, 121 nt, Human
gagaggccaaauacagaaaauuuaaggagucacucacucucagggucuugcaagagaguaggauggcauuugcagacucugagagugagugccaccuuaaauucuguacuaaaugcuucuc

SEQ ID NO: 4193712 - RNA, 55 nt, Human
gagaggcccuguggucccagcugaaacauugcagcagacccccagcuagccacuc

SEQ ID NO: 4193713 - RNA, 63 nt, Human
gagaggccuucuugaucuaaacacugccuccauaggcaguaacuaggacaaggaggaagacuc

SEQ ID NO: 4193714 - RNA, 73 nt, Human
gagaggcgugugugugcuccccaggagagcuguaacgacacucccuuuccaggaaacacaaaccaggccucuu

SEQ ID NO: 4193715 - RNA, 61 nt, Human
gagaggcugcauaugcacacugucugguucacaguaagauguccaaauauaguagcucuuc

SEQ ID NO: 4193716 - RNA, 63 nt, Human
gagagggcaagguagaugcuacaaaaauuaucuuuuuccucuugaugcuuccccugcccucuc

SEQ ID NO: 4193717 - RNA, 63 nt, Human
gagagggccagggugagaacuaauguucaagagagugagauuuuguaauccucuugcccucuc

SEQ ID NO: 4193718 - RNA, 62 nt, Human
gagaggggaccugugugucuaggugaugucacucagcagcaugaugacagagucucuggguc

SEQ ID NO: 4193719 - RNA, 97 nt, Human
gagaggugaagucauuugcugaagguucauauuacugcugaaugucagagucaggauuuaaacucagacaaaucugauuucaaaaguauucccuuuc

SEQ ID NO: 4193720 - RNA, 55 nt, Human
gagaggugaccaggggugacuggcugcccuacagucaaguucaccuucuccucuc

SEQ ID NO: 4193721 - RNA, 67 nt, Human
gagagguguguuucagauaagaaagggugugugugcacuuuccugaaugugucugaagccacuuuuu

SEQ ID NO: 4193722 - RNA, 83 nt, Human
gagaguacucucccuuggagccucaggcugcagcuguucagcacucagauggggacuugagcauuccaauggggauugcuguu

SEQ ID NO: 4193723 - RNA, 62 nt, Human
gagcucgccgauccauuuccugucauucacuugagggugacaaagcaugauggugacagcuc

SEQ ID NO: 4193724 - RNA, 57 nt, Human
gagcucuuuccugcccauacugggaacggucuuuuagugauggugagugagaagcuc

SEQ ID NO: 4193725 - RNA, 116 nt, Human
gagcugagcaauccuuguagccccuauaguucgguuccuccauguugcugcuuccucccuguaaaggcagguggugggggagccguucugugcaguggaggggcagaugccagcuu

SEQ ID NO: 4193726 - RNA, 68 nt, Human
gagcugaggccagagucuucugcucgguaucugacaucaagucucugccuugggcuuggcuucagcuc

SEQ ID NO: 4193727 - RNA, 57 nt, Human
gagcugcaggcauuuauucaugcaagcuuccagcucgcuuaucuaugucugcagcuc

SEQ ID NO: 4193728 - RNA, 57 nt, Human
gagcugccaagauuacaaucaguugaauuaacuuagggcuguguucuugguagauuc

SEQ ID NO: 4193729 - RNA, 55 nt, Human
gagcugccagacaugggaaugaagccuuguuggauuuuccagucuggccagccuc

SEQ ID NO: 4193730 - RNA, 121 nt, Human
gagcugcccaguugggagucagccccacucuccucaaaggcccuuuagcagaggaggggacugcagcuccuccaggucuaggguggcuucaggguggaaggcacucucccugacauagcuc

SEQ ID NO: 4193731 - RNA, 74 nt, Human
gagcugccgcugaccgggagacuuugagcaccauguuuaauuuaucugggcuucaauuuccuuagcuaucucuc

SEQ ID NO: 4193732 - RNA, 58 nt, Human
gagcugcucaggacuccgcuuaccaaaaucugcuggguugugguagguugggcaguuc

SEQ ID NO: 4193733 - RNA, 85 nt, Human
gagcugcucccagccagcuguguggucaggcaagucauucucccagaagaugcugcaguuuguuugaccauaaagugggcagcuc

SEQ ID NO: 4193734 - RNA, 58 nt, Human
gagcugcuucugugugccgggugcaugccaaugaaccuuggcccacugaaguagcguc

SEQ ID NO: 4193735 - RNA, 55 nt, Human
gagcuggaggaccaggacugggcaaagacauugcucccagucuccuugcagcauc

SEQ ID NO: 4193736 - RNA, 93 nt, Human
gagcuggaugcgaucaucagaaaguaacacaagagguccuugcggugauggaaacgcugugugucuugacuguguuaaugucguauccugcuc

SEQ ID NO: 4193737 - RNA, 60 nt, Human
gagcuggcaaugacuuguguaucacccucuuucaaaagaagcacaaucauugacuaucuu

SEQ ID NO: 4193738 - RNA, 57 nt, Human
gagcugggccugcgagugcugccccgacggggccugcuccacaucgaggcucagcuu

SEQ ID NO: 4193739 - RNA, 60 nt, Human
gagcugggucuccaccuuggcaucuccagcacuccaccaugccaugcaggacccagcauc

SEQ ID NO: 4193740 - RNA, 60 nt, Human
gagcuggucaguuucaggagagugcacagagcaggaccucgugggacuggccuagagcuc

SEQ ID NO: 4193741 - RNA, 56 nt, Human
gagcuggucgaaaugggcugacuacaugacagguagagcgccuuuucaacaagcuu

SEQ ID NO: 4193742 - RNA, 76 nt, Human
gagcuggugaucagcuggaggauucugaguccuaaccauacccugucaugacuaaagccuucaugguccuagacuc

SEQ ID NO: 4193743 - RNA, 56 nt, Human
gagcugguggugagaaagcucucucaaagccugacaagucaucuccucuacugcuu

SEQ ID NO: 4193744 - RNA, 66 nt, Human
gagcugucaaucacuuuuaccaaucagcuauuuuugauagaagaucuuaaaagcugacugcaguuu

SEQ ID NO: 4193745 - RNA, 56 nt, Human
gagcugucucuauaugaaugcucaguaaacaugccagucaucugcagggauagcuc

SEQ ID NO: 4193746 - RNA, 59 nt, Human
gagcugugaaaagugccuggggcaccuuguggguguuaaaaaggauugguuauaagcuc

SEQ ID NO: 4193747 - RNA, 57 nt, Human
gagcugugguaggcacagagaacaagaaacuauuucuugaaaagccuacagcaguuc

SEQ ID NO: 4193748 - RNA, 79 nt, Human
gagcugugguguuaacuggauuucuuucugaacaaagucauugaccauuuuguaagcaaaaaguccauucuccaagcuc

SEQ ID NO: 4193749 - RNA, 67 nt, Human
gagcuucaugccuaaagacagcgucuuaaacugcuugaauggcugcgagugucuuagcaugagguuc

SEQ ID NO: 4193750 - RNA, 57 nt, Human
gagcuuccucagccuuucucacccaggaccuuaaccuugauccagcuguaggaacuc

SEQ ID NO: 4193751 - RNA, 73 nt, Human
gagcuucuugccgauggccgggauuuuaaaacugccucuuuagucccagcccaguccuguaagcaacagucuc

SEQ ID NO: 4193752 - RNA, 63 nt, Human
gagcuugaugaaauuuuucaauugucuugaaagggcaguuauauuguuuuauucauguggcuc

SEQ ID NO: 4193753 - RNA, 60 nt, Human
gagcuugugauagaaggagcgguaguccuuuggcuuuaguuccagguggucacagagcuc

SEQ ID NO: 4193754 - RNA, 79 nt, Human
gagcuugugugggucaacugggauaaagagcuaaagaggucccuuuucuuccugcuuugucccaugucaaccacaacuc

SEQ ID NO: 4193755 - RNA, 61 nt, Human
gagcuuuaaucugagggaacuugaacuccguguaguugggguucaucucucggauuuguuc

SEQ ID NO: 4193756 - RNA, 61 nt, Human
gagcuuugaucgcuaagccucagggugggugagcauuuuuugaggcugccaauccaagcuu

SEQ ID NO: 4193757 - RNA, 67 nt, Human
gagcuuuuauaccuucucucagaaacacauaguaacauucugguuccaaagagaugguguagaguuu

SEQ ID NO: 4193758 - RNA, 123 nt, Human
gagcuuuucauuaauuugugccagaccauuuaauauauucuacaguguucuuguuucacuuaauuuucuggauuuccaagaaagcuuuaggauuugguuuggugagaggccuugaagggacuc

SEQ ID NO: 4193759 - RNA, 77 nt, Human
gagcuuuucuuuauacaccugcugagccuguccucagccagggguuaagaggauaaaaggcucaaagcagcaggcuc

SEQ ID NO: 4193760 - RNA, 82 nt, Human
gagcuuuuucauagauaucuuucuuauuugaagaaagauaguaucuaucuguuuuagauaagaaaggcuugugcaauaguuu

SEQ ID NO: 4193761 - RNA, 97 nt, Human
gaggaaaaugaagaaauggugaagaagaagaagaugauguugaauaaguugguucuagcacaguuucuuuuccuugucuauaaagcauuuaacccuc

SEQ ID NO: 4193762 - RNA, 83 nt, Human
gaggaaaccauugcugcccuaauaucacauguuacaagucuucgagcccaugguaucugagauguuaggagcuagcauuccuu

SEQ ID NO: 4193763 - RNA, 75 nt, Human
gaggaaagcugguuuaaaguaucugagugaaauaagaggaaaaccccaaauacuucaccuaacccaguuucccuu

SEQ ID NO: 4193764 - RNA, 62 nt, Human
gaggaaaggcuauugcugauaauguuuucaguggaaaaacauuucacccauggucuuuccuc

SEQ ID NO: 4193765 - RNA, 64 nt, Human
gaggaaagggcaggaagaggagccccugucugagaaacacagucagggucuggcccuguuccuu

SEQ ID NO: 4193766 - RNA, 129 nt, Human
gaggaaaggugcuuacuaaauucaagaaaugguguuuuuuucuccuuauucauaguugucuccuuggagagaccauauugaggggaaccugccaggaacacuuuuugaaaaagucaauuauucuuccuu

SEQ ID NO: 4193767 - RNA, 85 nt, Human
gaggaaauguuuuaaaagugugcaccuuuuguaaaaaggcuagagaagcccuuuauacuaaggcauacaauagacucauuuucuu

SEQ ID NO: 4193768 - RNA, 66 nt, Human
gaggaacagauauuuggggaaagacguuaguuuuagacgcugaguuucagguuucugagacuucuc

SEQ ID NO: 4193769 - RNA, 77 nt, Human
gaggaacuagagagaagcugugugaccuucccuaacuucaccugagaaguuacacagugucacuucuaccacacuuc

SEQ ID NO: 4193770 - RNA, 82 nt, Human
gaggaagaagaaaccagcuccagccuccauucacccugggaugggguaugggugggcuggggugguaaugaaggucuuccuc

SEQ ID NO: 4193771 - RNA, 63 nt, Human
gaauacauggcuuuuuuagucugucuaggaagacccuuaacagaauaguuggcccugcuauuu

SEQ ID NO: 4193772 - RNA, 130 nt, Human
gaauaccaggauucugaagcaaugagagugggauugggagagagagcucauguugaagaagaaauaacucaccaguucacaugggcuccuuuucaaggguuuuucuuuauauaaacaauuugccugguuc

SEQ ID NO: 4193773 - RNA, 90 nt, Human
gaauaccauuaaucuguucacuaggagauuaauuugcaauuuguuggcaaaucacaugugggucuuguagcaagagcgugggugguguuu

SEQ ID NO: 4193774 - RNA, 55 nt, Human
gaauacuucucacugugaaauaggucuuuauuauguuuuaaagugacugguauuu

SEQ ID NO: 4193775 - RNA, 66 nt, Human
gaauacuugaagaggacuuugcagcugucuggaguucucuguauagcucuuuccuuuccaguauuc

SEQ ID NO: 4193776 - RNA, 60 nt, Human
gaauagaaucaagaaaaugaggauucuucccuucugggaagcaauacuucuugguuauuc

SEQ ID NO: 4193777 - RNA, 59 nt, Human
gaauagaauugcauaauuuuaggguuuuaagcacccucaguaaucgugcaguuuaguuu

SEQ ID NO: 4193778 - RNA, 86 nt, Human
gaauagcaaagugacagggaagcagucagcagucaggcaucauucagcugcccaggauaaugcugucccugugcacagggcuguuc

SEQ ID NO: 4193779 - RNA, 67 nt, Human
gaauagccuacugggcuucuguguagcacagcacuguguaagucgcagguguucaguaaauguauuu

SEQ ID NO: 4193780 - RNA, 80 nt, Human
gaauagcuguaggcuagugucuucagagaccaaucuauacucucucccagguaucuguuuuuacuuguuugcuguuguuc

SEQ ID NO: 4193781 - RNA, 78 nt, Human
gaauagguugucagugguuauacuuacuguuucuccaccaggaugaaauuauauuaaaaucacuugaauggccucuuc

SEQ ID NO: 4193782 - RNA, 78 nt, Human
gaauauagugauuauaucaguaaaaacauuguaaagccacuauaauagcucacaguguaugauauuucacaguuguuu

SEQ ID NO: 4193783 - RNA, 79 nt, Human
gaauaucuuaagauuuauaguaggaugugacaagucuaacagaggcuuacaaacugucauauaguauuuuaggauauuu

SEQ ID NO: 4193784 - RNA, 117 nt, Human
gaauauguacaugaacaaaauagcagaaagaaguacaggacaaaaucuaggcauguucagaauaacaugccuagauuuuguccuguacuucuuucugcuauuuuguucauguuauuc

SEQ ID NO: 4193785 - RNA, 68 nt, Human
gaauauucagaaaagugucugacguggagcaagcacucaguaacaugcagauauuuuuauugugguuu

SEQ ID NO: 4193786 - RNA, 66 nt, Human
gaauauucuugaaggaguacugugauaugaguaaaucacucauuuguaccauuuuuuaagagucuc

SEQ ID NO: 4193787 - RNA, 59 nt, Human
gaauauugaauuguuuguggaauuucaugaggccauggacuuucagacauuucaaauuu

SEQ ID NO: 4193788 - RNA, 64 nt, Human
gaauauuuucauguuucaaugggaucaguuuuucuaauucugacuauuggaaaagaaaauauuu

SEQ ID NO: 4193789 - RNA, 74 nt, Human
gaaucacaacccugcuuggccccacuucuauaaguuuggcuuuggaaacuuuaugccaagaggcuuuugaauuc

SEQ ID NO: 4193790 - RNA, 62 nt, Human
gaaucacagaggcaaauucugaaaagaugggugaaauccaaucagauagcacuuuaugauuu

SEQ ID NO: 4193791 - RNA, 119 nt, Human
gaaucaccugcagcguuuguuaaaacccaaauuccaggccuuucucccagacuuucuaauucagugggccuaggguuggccugagaaucuggauuucuaauaaguucccaggugagauc

SEQ ID NO: 4193792 - RNA, 90 nt, Human
gaaucaccuggggacuuuguaaauauauagaccucgacucaguaaaucugaguaaaaauucuacauuuccaaccagcucccaggugauuc

SEQ ID NO: 4193793 - RNA, 61 nt, Human
gaaucagauacugauuucagucauuuuuaauggcuuauugacuuaauauugguacugauuu

SEQ ID NO: 4193794 - RNA, 57 nt, Human
gaaucaggagccauguggauucuaaauuuaugauucagcagccauggcuucugacuc

SEQ ID NO: 4193795 - RNA, 77 nt, Human
gaaucauguugaugaagugaugcaguguaauccccaccuuguuaauugugugauaaugcaguccuuugacaugauuc

SEQ ID NO: 4193796 - RNA, 83 nt, Human
gaaucauucagucaugcugguuuugauccacaugguuuucaagccaguugaguuauuuuaagcacagcaugaaagaagaauuu

SEQ ID NO: 4193797 - RNA, 56 nt, Human
gaauccuggaaucaucugagaucaaaauagcaggucuggaagaagcagcaggauuc

SEQ ID NO: 4193798 - RNA, 91 nt, Human
gaaucuauggcccauuacccagaggaacguuuggauugauuaucagaaguacacuucaaggaauucaaauuuucucuggagucauagauuc

SEQ ID NO: 4193799 - RNA, 79 nt, Human
gagcaaaggguauuuucauaaaaccauggaaucuuugaguuggcuaaaucuccauaaauuuuaugaacauauuguguuc

SEQ ID NO: 4193800 - RNA, 61 nt, Human
gagcaaaugaagagggagaaugugguuugcaggcuuaaaauucaaaccucauuuauuguuc

SEQ ID NO: 4193801 - RNA, 75 nt, Human
gagcaaauguacaauagucccuguuuggaugcaccauacuuuauucaaguucacuacuguuggacauuuauguuc

SEQ ID NO: 4193802 - RNA, 64 nt, Human
gagcaacagggcgaggagaacuggacccugguucuggcucugggaugacuuugcccuguggcuu

SEQ ID NO: 4193803 - RNA, 68 nt, Human
gagcaagcugcuuaagcucauugucucauaauuuuccaugagcauaaugaguauagcauugcuuguuc

SEQ ID NO: 4193804 - RNA, 58 nt, Human
gagcaaggcagcguuccuuucuggacccucuagaggagaauccaggcguugcuuucuc

SEQ ID NO: 4193805 - RNA, 76 nt, Human
gagcaaguaucagcacaucuccaagaauuucugcagcagaaauucauggagacggugccaucaagugauuuagcuc

SEQ ID NO: 4193806 - RNA, 64 nt, Human
gagcaaugcccuucaccagccccuguauggauaggaagcaggggcuggagaggagguuuugguc

SEQ ID NO: 4193807 - RNA, 67 nt, Human
gagcaauggaagauagauaacaaaacuuuuggugaaguucuacacugccuaucugucuuugaugcuu

SEQ ID NO: 4193808 - RNA, 116 nt, Human
gagcaauuguuuuugucaccccuuuucuuccuggcaugccuugaacauaguggacaguaauaauuauuguuaccauuugugaaggcuuacuaugugccaggaaaugcaguaugcuc

SEQ ID NO: 4193809 - RNA, 59 nt, Human
gagcacagaaggagaaauauggccccgaggggcuagcauauuccucuaucucauuguuc

SEQ ID NO: 4193810 - RNA, 130 nt, Human
gagcacagaugguugccaguccccucuucagauacguggagccuagagugcugagucugggcugaagugcaguacuuguccucagguguuauugugugaggcugaggggaaaagcuagaaaccaugucuc

SEQ ID NO: 4193811 - RNA, 74 nt, Human
gagcaccaaggccaguucaccaagggcaaaaucccuacuuguguccuuccuguugaagggcuucugugauacuc

SEQ ID NO: 4193812 - RNA, 59 nt, Human
gagcaccuggcagcuaagugcuuugagaucuuucagaugaaaagggcugucaguuguuc

SEQ ID NO: 4193813 - RNA, 57 nt, Human
gagcacuaggcaugguuguaaaaaucuagacucuuuucauccauggcuuuugugcuu

SEQ ID NO: 4193814 - RNA, 82 nt, Human
gagcacugaauuuuuauccaguuuuguuuaucauuucagcuaggccauuuggcacugggaaugugagcagcuggacagccuu

SEQ ID NO: 4193815 - RNA, 58 nt, Human
gagcacugccucuguggagaauguauaaagagauacaaaggaacacaggcaugugcuc

SEQ ID NO: 4193816 - RNA, 83 nt, Human
gagcacuuaaauaugagcagaauugauguuuggcauuucuguguggagucauuuaauugguuuugcucgucuuucuaaguauc

SEQ ID NO: 4193817 - RNA, 83 nt, Human
gagcagagaugagacaugcauuaagacacacugaaucuaacuagaaauuuaucagaaauguuauauaugcuuuaucucugcuu

SEQ ID NO: 4193818 - RNA, 81 nt, Human
gagcagauuggcacuuuuaggcaguaccgaauuaacaucaaaaugucauugcugagccauaagguugcccccauuuuguuu

SEQ ID NO: 4193819 - RNA, 72 nt, Human
gagcagcagacccagagcagagcuuggcuuccugcaaggaaaucugcccagugcacugguuggcugcugcuu

SEQ ID NO: 4193820 - RNA, 65 nt, Human
gagcagcccuuucugggcaggggaauacauacauacacauaacucucacagcccuggggcuguuu

SEQ ID NO: 4193821 - RNA, 77 nt, Human
gagcagccugaggagcgugggccggucacuugcuauagcagccaucccgggaagucacuguucaucacggcaugcuc

SEQ ID NO: 4193822 - RNA, 91 nt, Human
gagcagccuggagagccuggaccugagcuacaaccccaucuucuccuccucccuugucguugucagcuuccuccacgcccugcgcgagcuc

SEQ ID NO: 4193823 - RNA, 64 nt, Human
gagcagcuggcuguauugguuuguaaggaaaugaugcaacaagccaauaacaguagucugccuc

SEQ ID NO: 4193824 - RNA, 64 nt, Human
gagcaggaaucacaugcaacuggaggggucagcaaugagggccaggagcugugugcuuccuuuc

SEQ ID NO: 4193825 - RNA, 60 nt, Human
gaggaagaagggauuagaacucucggccaccauacugccucguucugcagcuucuuucuc

SEQ ID NO: 4193826 - RNA, 60 nt, Human
gaggaagaaucaggguggugaggcaauuaguagguguucuacaauccugacaucuuucuc

SEQ ID NO: 4193827 - RNA, 57 nt, Human
gaggaagagcauggccaguuucuacaaaggggccuuuggccagcugcucgucuccuc

SEQ ID NO: 4193828 - RNA, 57 nt, Human
gaggaagaggacagagugguuuugggaguuauuuaaccacucuaaccauauuuccuc

SEQ ID NO: 4193829 - RNA, 84 nt, Human
gaggaagcagaauagauucaugguuaagagcacagauccuggaaccagaaugccugaaaucaaauccuaguucugucacuccuu

SEQ ID NO: 4193830 - RNA, 101 nt, Human
gaggaagucacauuucuugugugccugcucuugagacuuacaacugccacugucguugugucuccucucuggguggcagggaauacugaagaaauuuccuu

SEQ ID NO: 4193831 - RNA, 73 nt, Human
gaggaauaauaucuggcauucaaacaugacuggggaaaguuuauguuccaauuagccagaauggaaaaaccuc

SEQ ID NO: 4193832 - RNA, 130 nt, Human
gaggaauacaugggaagaacgcagggaauuuuuagggcagugagacuauuuuauacaauacuauaauguuggauacaugucaucauauguuuguaaaaauccauaaaauguacgacacaaaagcaaacuc

SEQ ID NO: 4193833 - RNA, 74 nt, Human
gaggaauauguacgggauuugacuccuggauccaccaucuuccugugaugaucuugagcaaguuguguaaccuc

SEQ ID NO: 4193834 - RNA, 76 nt, Human
gaggaaugucagcacaggccucucucaggaugucccuucucugacauccugagagaggccugugcugacauuccuc

SEQ ID NO: 4193835 - RNA, 65 nt, Human
gaggacaacuagaucaaggcaagcacguggccugggugugcuucagcagggaucggggggucuuc

SEQ ID NO: 4193836 - RNA, 62 nt, Human
gaggacaagcugugagugggguugcagaacaagucuggagaacccugcuuuaugccguccuc

SEQ ID NO: 4193837 - RNA, 77 nt, Human
gaggacauauuuugaaagcuuucuaauccuugcuaugacaaugacugaacuuuuagagggcucagaguuagagcuuc

SEQ ID NO: 4193838 - RNA, 81 nt, Human
gaggaccuguuuagugaggugaggaguaacuggcuaugguuuuaugaugccacggcuucuccacuuccucaagcuggccuc

SEQ ID NO: 4193839 - RNA, 67 nt, Human
gaggacuggugaggacugguaaggacugcagcacccugggcuggguccucaccuccucacuggccuc

SEQ ID NO: 4193840 - RNA, 62 nt, Human
gaggacugguggcugauuaauguucaaugacccacggggacagcccaggccgacaguuccuc

SEQ ID NO: 4193841 - RNA, 56 nt, Human
gaggacuucauggcagauugcuggagcuaagaaaggcaguaugucuaugagucuuu

SEQ ID NO: 4193842 - RNA, 63 nt, Human
gaggacuuggucagcuucuucccucaaggcaaugggugcucagugaagaaguuggaggaucuc

SEQ ID NO: 4193843 - RNA, 122 nt, Human
gaggagaaaaucaaggcugagagacuguuacuugucugagguccuacuauaaguggcagagccagaauuugaauccacauaugauagggcaucucuaagagggucuccaugauucuccccuc

SEQ ID NO: 4193844 - RNA, 82 nt, Human
gaggagaaagagaggacaggauugagcugaacuguucaggagcuggaaugguuaggacuuggauuguccagagaguuuucuc

SEQ ID NO: 4193845 - RNA, 64 nt, Human
gaggagaagcuauuggaaggacauugcugugaauauuccugucagcuuucaugugguucuucuu

SEQ ID NO: 4193846 - RNA, 66 nt, Human
gaggagaaguacaaaggacauggaaacagccggcggggaggcugccauggauagcugugcuuccuc

SEQ ID NO: 4193847 - RNA, 81 nt, Human
gaggagaggguggcauuaaguuuucauacugaaugauaaaccuaucucauuuaaauaacaaacugaaugaaaucccuucuu

SEQ ID NO: 4193848 - RNA, 69 nt, Human
gaggagaggucaggagagaaggcuggcugaggagcgccuggacagcagcaguugcugacguucuauauc

SEQ ID NO: 4193849 - RNA, 81 nt, Human
gaggagaucaguguauuuccugcauggugauguaaguggugagaaaaaugcggcuguggcggugcaagaaauaagcuccuc

SEQ ID NO: 4193850 - RNA, 77 nt, Human
gaggagaugaauggauggaugccuccaccugucucaccaccaaugagcccacugaagcauucgccuucacccuccuc

SEQ ID NO: 4193851 - RNA, 94 nt, Human
gaggagccauggagugggggcuggcucugucuguauguucagcaauggauccagcagagaagaugcccaggcuuccagacacccuuggccacuc

SEQ ID NO: 4193852 - RNA, 113 nt, Human
gaggagcgggggggcggccugagagcccagggucaggguguggggccacuucagccacuccccugccaguggccuugggcacugaccuugggcaggccuuccucccuauccuc

SEQ ID NO: 4193853 - RNA, 71 nt, Human
gaggagcucaugaaagcgguguucacagcaugcugcaguugcucacaucguaguucauaaggcauuuucuc

SEQ ID NO: 4193854 - RNA, 65 nt, Human
gaggagcuguucccucaccucuggaagaaaaggaccucccugaggccaggggagucagcguccuc

SEQ ID NO: 4193855 - RNA, 65 nt, Human
gaggagcuugaggcuaggagccugauuuacuuccuguggacuugcacccuagcccagugcuucuc

SEQ ID NO: 4193856 - RNA, 74 nt, Human
gaggaggaacaggaggagcagcugugugcccaggcucagccugcagagggacagcagcucucauuccccucauc

SEQ ID NO: 4193857 - RNA, 62 nt, Human
gaggaggaaugaagccuuaggcauacaaauaauaaacuggaagccuggaguuaguuuuccuu

SEQ ID NO: 4193858 - RNA, 67 nt, Human
gaggaggaccaggcaaggucagcaccuucugugcuacagagaggcccaugugagucuuguccucuuc

SEQ ID NO: 4193859 - RNA, 89 nt, Human
gaggaggagccccacuggcagugcugaggagagguacuccagcuccaggccuggagagccuucccggcaucgccugcggaccccaccuc

SEQ ID NO: 4193860 - RNA, 57 nt, Human
gaggaggcaggugcagccucaguuagcaggaagccccugagaagcuccugucuccuc

SEQ ID NO: 4193861 - RNA, 79 nt, Human
gaggaggcugagcccccucugcguagggaucaaggggcugaacccucucugcgugggacugaggaggcugagcccucuc

SEQ ID NO: 4193862 - RNA, 64 nt, Human
gaggagggaagauuccccauaugggucaugauauuacugccccaaggggagauuuucuugaguc

SEQ ID NO: 4193863 - RNA, 60 nt, Human
gaggagggggaugcaccuggggugcuggaaacaugcgugcagggguccuccuggagccuc

SEQ ID NO: 4193864 - RNA, 78 nt, Human
gaggaggggucagugaugucaggugccucagcaggcugauugccacugaguucccugacauuucaaggcagccucuuc

SEQ ID NO: 4193865 - RNA, 74 nt, Human
gaggaggggucuggguggccuucauagcucagggugagauacccuuggguccugagugaccccauccccuccuc

SEQ ID NO: 4193866 - RNA, 72 nt, Human
gaggaguauucauuuugcaugaaaggaccagaaguauuccccggcuuuucauguguugaauguguacagcuc

SEQ ID NO: 4193867 - RNA, 80 nt, Human
gaggagucacugcagguuuuucaggaggagagugacaacacaaucuaguaccucuucgagagccagcagccacaguccuu

SEQ ID NO: 4193868 - RNA, 96 nt, Human
gaggagucauauuuggggccuuggcacucauccugguuguuuacgcagguguaaacccguacgcgggauguaguuccaugcacucaugguuuccuc

SEQ ID NO: 4193869 - RNA, 82 nt, Human
gaggagugcuugcuggcagccuauaaggccucacugggugggguuaaccuagugauggcaucggguccagcaucugguccuc

SEQ ID NO: 4193870 - RNA, 67 nt, Human
gaggaguggaguugcuggguuguaugguuaguguaugucuaacuuuucaagaaacugccacaccauc

SEQ ID NO: 4193871 - RNA, 61 nt, Human
gaggaguggcagcuaggcugucagucaacuguguugauuuccguagcugccacaauaccuc

SEQ ID NO: 4193872 - RNA, 93 nt, Human
gaggauaaagggaauccugaaucugaagcagauguggcugagaucuuuggcccaugaaaggugcucagugagugcuucauuuccuuugucuuc

SEQ ID NO: 4193873 - RNA, 70 nt, Human
gaggauaaagucuuuagguggacagauuaggaaaguccugugcugucuacuuaaagacuuuuugucauuc

SEQ ID NO: 4193874 - RNA, 72 nt, Human
gaagcuggugcucacuuucaucauugccugaguuuucccaagcagcuuuugaagagugaggaacuaaguuuu

SEQ ID NO: 4193875 - RNA, 124 nt, Human
gaagcuguauaaauuaucaaguaauaugagaauuggaaaauaucauuauaaguaacuugugaaaaccccugauguuuuaaauuagccaugaaaugugacuuacuuuguaauauuaugaagcuuc

SEQ ID NO: 4193876 - RNA, 65 nt, Human
gaagcuuaacaguacuaaagaagagaaguuggcaaacucguucuuucugaauacaguugaguuuc

SEQ ID NO: 4193877 - RNA, 70 nt, Human
gaagcuuggcuguguucaagggcggcuggcuacugucagucucaccucccuuaacacuuuuguuaaauuc

SEQ ID NO: 4193878 - RNA, 70 nt, Human
gaagcuuuaacuauuaugaaugccuggguaccauucugauguaaugggccuggguuguaacuagugcauc

SEQ ID NO: 4193879 - RNA, 56 nt, Human
gaaggaaaaauacucuguaagguuucaaaaacagccgauugcagagauuguccuuc

SEQ ID NO: 4193880 - RNA, 129 nt, Human
gaaggaaacacgagaccuuggcaucccucucacucgaaggcauggcaggguuuacacaauuaggcuuaauuauguccugcucugcuuucagugaguguguuccuugcagguggagucuggcuuucccuc

SEQ ID NO: 4193881 - RNA, 72 nt, Human
gaaggaaauaaauaauuuguggccacauuguggaacgugauaaauuguuucauggccacagauucuuccuuu

SEQ ID NO: 4193882 - RNA, 60 nt, Human
gaaggaaccugagggaccccaaacucagccacucuuguaguuucccucuccgguucuuuu

SEQ ID NO: 4193883 - RNA, 74 nt, Human
gaaggaagaagagauaauggggagcaaguacaaggggaaacgagaugaugucuugccccucuuuucuuuccuuc

SEQ ID NO: 4193884 - RNA, 63 nt, Human
gaaggaagcuuucuguguuaaugcugcucgucagagacaguaauaacacagaaaguuugcuuc

SEQ ID NO: 4193885 - RNA, 95 nt, Human
gaaggaauacucauggcaguggugauaaccgcuaucauagcuaccauaaaauuacucguugugacugguugucccgcuuuccucagguuuucuuc

SEQ ID NO: 4193886 - RNA, 110 nt, Human
gaaggacuguccaggcugggaaugagguuaggguaucagaagcacagcccccugagggcugagucaucuggggccuccuggaucuguucugcaguuugaaugcagccuuc

SEQ ID NO: 4193887 - RNA, 125 nt, Human
gaaggagcaaacauugcacacagggaagugguuauaacacagguuugugguaaauaagaagcugucaaaggccuuauccagagcuugugguuguagccagcugagacccaauguaugcucacuuc

SEQ ID NO: 4193888 - RNA, 63 nt, Human
gaaggagcuaaagggagcccugccggcacauaacgaccgccgggcuccaucacaggcuccauc

SEQ ID NO: 4193889 - RNA, 59 nt, Human
gaaggaggcguuagcccuaggagguaccugaaguuaccugggggcaacgcguuuucuuc

SEQ ID NO: 4193890 - RNA, 85 nt, Human
gaaggauggagaagcacaaaacacauuuugacaaugugcugguguuugcagcuggaaacuuggcgcaugucagaucccauccuuc

SEQ ID NO: 4193891 - RNA, 73 nt, Human
gaaggauguauagggccaugacaccacuccugaugauacuacaaugguggacgcaugucauuauacauuuguc

SEQ ID NO: 4193892 - RNA, 73 nt, Human
gaaggauucaccuguuaguaaaaaucuguaguuugaccuacaugaaagaugacagcuacgggaugaaaauuuc

SEQ ID NO: 4193893 - RNA, 75 nt, Human
gaaggcagauuuuaaaaaugucguuaccagaacgcauccuccauuucucaguaaacagguuuaaguccugcuuuu

SEQ ID NO: 4193894 - RNA, 60 nt, Human
gaaggcagcagugcacgacugauguaagugaggcauuagggcaaaccacugcaugcuguc

SEQ ID NO: 4193895 - RNA, 62 nt, Human
gaaggcaggaugcggacccaucuugguagcccagaagacagggccacucauccucacccuuc

SEQ ID NO: 4193896 - RNA, 63 nt, Human
gaaggcaggggacccucacucuaugcugaaggggcugggggcugagauuggugcccugucuuc

SEQ ID NO: 4193897 - RNA, 58 nt, Human
gaaggcagguuuuucaaaacugggcuaagcaauuaucaaacugaacuaaccugcuuuc

SEQ ID NO: 4193898 - RNA, 55 nt, Human
gaaggccauugcguccugggauucuauuuuuugaccugauguucacuuggccuuc

SEQ ID NO: 4193899 - RNA, 88 nt, Human
gaaggcccuucucuccagcagagccagauuuuaugcaagacauuuaguaugucaaaguaucagucucuggccuuggaggcaggucuuc

SEQ ID NO: 4193900 - RNA, 69 nt, Human
gaaggccggagcagcagcuuuuacugggggacaacccauuuccagcagcuaccugcucuuguggcguuu

SEQ ID NO: 4193901 - RNA, 61 nt, Human
gaaggccucacucugcagcauaaggguauuuuauacuuagcugacaaguccagagcccuuc

SEQ ID NO: 4193902 - RNA, 106 nt, Human
gaaggcguguccugccagaggugaggggaucugggcccacucaacuucacugauguaggcagugggguccaucccuucccucuggcaugaggaaguaugcaucuuc

SEQ ID NO: 4193903 - RNA, 55 nt, Human
gaaggcuacuucuccucagggccacagagagacgggcccugaggcaaaagccuuu

SEQ ID NO: 4193904 - RNA, 84 nt, Human
gaaggcugggaguccaagaccaaggugucaccagaguuaguuucuucugaggucucucgccuuggcuuguagaugaccaucuuc

SEQ ID NO: 4193905 - RNA, 69 nt, Human
gaaggcuguggcuggucucaguuugguuacucaaugcccaggaggggcugagcaccagccauaucuuuu

SEQ ID NO: 4193906 - RNA, 59 nt, Human
gaaggcuuaaugguucuuuuucucauuucaggucaaaggugaguuacaauugagucuuc

SEQ ID NO: 4193907 - RNA, 68 nt, Human
gaaggcuuccaggugcuucuguaagaaagacaccugugaucuccccuucuaaguaccuuaagcugcuc

SEQ ID NO: 4193908 - RNA, 93 nt, Human
gaagggaagaauugaagcagcauugugguaggggagcacugaaaccccauugcaucccccaucugugcccaauuuguuccaaucuggcccuuu

SEQ ID NO: 4193909 - RNA, 72 nt, Human
gaagggcaacaacuggacauagcuggcaacuaguccuaauggccauugcagcuguguuucaaaugaauuuuc

SEQ ID NO: 4193910 - RNA, 85 nt, Human
gaagggcuggcauggaagggcugaguucuauuggggucccacgcgggcaagggaaccaggacucaucccugcuugucagccaauc

SEQ ID NO: 4193911 - RNA, 74 nt, Human
gaaggggucuugggaggagagaggguggacccuguucccaggcacucuguuucuccugucagccuugccucuuc

SEQ ID NO: 4193912 - RNA, 129 nt, Human
gaaggguccgcugcucaggcagcauccccgugccucuccuccagugggucccucagguagaaucggggcaggccccacuggacgugcagggaggaggcucggaggaugcauccuuugcaggacccgguc

SEQ ID NO: 4193913 - RNA, 57 nt, Human
gaagguagagaggaguuucugcauguuguucauguuuaacacugcuucuauauuuuc

SEQ ID NO: 4193914 - RNA, 71 nt, Human
gaagguagcacuauagggucuugccuuggccuaaggcuaugaaaaagcaugauaccauagguuuugcccuc

SEQ ID NO: 4193915 - RNA, 81 nt, Human
gaagguagcuucauaacauuacagacaccuuguguuauuuuaauaugacacuuuuagcuaugaguuaaugagacugccuuu

SEQ ID NO: 4193916 - RNA, 65 nt, Human
gaagguauaucagacacucauauguaugggugcccccauacaggccaguaauuugguauguuuuc

SEQ ID NO: 4193917 - RNA, 130 nt, Human
gaaggucaccgugagggugagggcuccugcuggaacccgugucucucugggcacaagggccagggcacuccuggcccagcucagggugggcgggguguugguggagccucugccccucuuccagguacac

SEQ ID NO: 4193918 - RNA, 130 nt, Human
gaaggucauuggcagguaugugaaucuuccuggaccaggagagcauacaccucucucaucugcuagguacugucucugcccuggccaggccaauuuaaaccuucacagcuuaucagcuuggacucucuuc

SEQ ID NO: 4193919 - RNA, 111 nt, Human
gaagguccaaugcugcugcacaucuuugcaagugauucuguuuucucauguuacacacagugagagaguuagggauccuucagacucgucagucuugccaauuggucuuuc

SEQ ID NO: 4193920 - RNA, 67 nt, Human
gaaggucuggcugccuggagugagggagagagcggggugagacuccccccagggggccaggaacuuc

SEQ ID NO: 4193921 - RNA, 83 nt, Human
gaaggucugggauggugcuuuuucaaucagaagggaguagucauuuucccucucucuaaggagagggccuccucccucccauc

SEQ ID NO: 4193922 - RNA, 62 nt, Human
gaagguugaagaggaagaugacuaguggaauacuaauagauucugacccucuuuuuacuuuu

SEQ ID NO: 4193923 - RNA, 80 nt, Human
gaagguuucuuacauuuguaacucucccuuuguauauuucgaauguuugagagggggaguuauauuaaaauaaaacuuuc

SEQ ID NO: 4193924 - RNA, 80 nt, Human
gaagguuugcuuugguagcagcuauagauagcuaagaucauucuuugugaaauguauggcaugcaacuuagcauuaauuc

SEQ ID NO: 4193925 - RNA, 58 nt, Human
gaagguuuucaggagccuagucuuagaaucauagagguucuuggcuccugguuccuuc

SEQ ID NO: 4193926 - RNA, 100 nt, Human
gaaguaaaagauaaugucuuauuaucaugaguucagcaaguuucacacauugcauuuggcaauuauauugguuaacucugugugucaagacagugacuuc

SEQ ID NO: 4193927 - RNA, 72 nt, Human
gaaguacacauccuucugaacaaccuugcuucagcgcugcaagguuuuaccacuuagugaugcugugacuuc

SEQ ID NO: 4193928 - RNA, 72 nt, Human
gaaguagagucaaaacugucuagagagagaaggaagcugacccuugccucugcuaaugguuucugcugcuuc

SEQ ID NO: 4193929 - RNA, 64 nt, Human
gaaguagcauguugcugccagaauacuagcauuucuuuuggcaaacugaaguacaugucacuuc

SEQ ID NO: 4193930 - RNA, 64 nt, Human
gaagucacuaagauuuaaaguauuaguguaggaaaauacgauacacaguaaucauagagacuuu

SEQ ID NO: 4193931 - RNA, 65 nt, Human
gaagucacuauugagcauuauuugcuucacuguacagaggaaggaacugaugcucaaagaauuuc

SEQ ID NO: 4193932 - RNA, 56 nt, Human
gaagucagaggagcugucuuugugaucuucgggaagucacuuuagcucccugaguc

SEQ ID NO: 4193933 - RNA, 63 nt, Human
gaagucagcaguuuuauaugcagcuucaauguaaaacacaagguucuguaugaaauugacuuc

SEQ ID NO: 4193934 - RNA, 111 nt, Human
gaagucaggaaaucgauaaacucaauagugucugcuuguuucuaccgaaugauaaaaagaauucuggaaagaaaguaaaggcguauuucaagguuuauguuuucuuccuuc

SEQ ID NO: 4193935 - RNA, 64 nt, Human
gaagucauaaagaguagcauuucgaauacaguaaacacuguauuaugauuguuguucaugauuc

SEQ ID NO: 4193936 - RNA, 106 nt, Human
gaaguccaagaugaagguauggcaaguuucacagggccauggaggaaguaucuguucuaggcuucuccccuuggcuuguagacggguaucuucuccuugugucuuc

SEQ ID NO: 4193937 - RNA, 110 nt, Human
gaaguccucagaccucucgguaccacauuaggcccuugucagcuagucagucacacccuaguaucagcuggcucagggacuagaguuuuuauugagaggagggggucuuu

SEQ ID NO: 4193938 - RNA, 68 nt, Human
gaaguccuguccucaggaaagcagauaacaggauacugauccuaaucugaggauugagagaagacuuc

SEQ ID NO: 4193939 - RNA, 72 nt, Human
gaagucucuuggguuuaucuguagagcuucaccuaccucauccaaugguauauugauagacccagggauuuu

SEQ ID NO: 4193940 - RNA, 92 nt, Human
gaagucugagaugaaggugcaggcaagguugguuucuucugaggccucucucccuggcuugcagauggccaccuucaucucccagugucuuc

SEQ ID NO: 4193941 - RNA, 58 nt, Human
gaagucugccugccuucucugugaacccaggggguguagaaaagaaaggggagccuuc

SEQ ID NO: 4193942 - RNA, 67 nt, Human
gaagugaagauaagcugauguaaauucacuuuauuuggauuucaauccagcuuucuucuuugauuuc

SEQ ID NO: 4193943 - RNA, 74 nt, Human
gaagugacaauucuggguagggcaaggaacuggcccugaaucuggugcuuagccuugccugccuugucaucuuc

SEQ ID NO: 4193944 - RNA, 56 nt, Human
gaagugacagaagggaugggcagcuuccugucuaaaacugacccuucuaccaguuc

SEQ ID NO: 4193945 - RNA, 56 nt, Human
gaagugagcuaggggaguuuaucaugugugugauccuuggcuucucuguuuauuuc

SEQ ID NO: 4193946 - RNA, 55 nt, Human
gaagugauguuucagugucaacuaaagcugaugucugauguugugacaucacuuc

SEQ ID NO: 4193947 - RNA, 84 nt, Human
gagggccagggcucugucuucagcacacaguaggcaccuguaaauguuugcucaguugcggcgaagacaagcagucagguucuu

SEQ ID NO: 4193948 - RNA, 63 nt, Human
gagggcggcaucgcguccuugucugcugucugggcacagccuagagaggccgcggguccccuc

SEQ ID NO: 4193949 - RNA, 61 nt, Human
gagggcugagacuaaggccagaugugguauuuuaucugcauucuaccccuucucugcccuc

SEQ ID NO: 4193950 - RNA, 80 nt, Human
gagggcugcugucucuuugcaagaugaaagauguggcauuguugcugugucuucacaaagcagaagggaugaaagcucuc

SEQ ID NO: 4193951 - RNA, 96 nt, Human
gagggcuggaaaggaaagguagcgugccagcaggcaagcagggaaaauauaugcugcagucacuguuaacauucugcauguuuccuuccggucuuc

SEQ ID NO: 4193952 - RNA, 74 nt, Human
gagggcuggggcugugaggugagaacuuaccuggcauugggacugccagguacauccccaaagccacgccccuc

SEQ ID NO: 4193953 - RNA, 71 nt, Human
gagggcuggggcuuaggcuuaggcaaaaugaaguaaccaacagagccucuuugcaguaaauuccaguucuc

SEQ ID NO: 4193954 - RNA, 98 nt, Human
gagggcugugauuugcuuuaaauuucaugguacaucgugacuugcucagguugcauaguugauaagcuguaaaguuugaauuauaaucgcuuuuccuc

SEQ ID NO: 4193955 - RNA, 86 nt, Human
gagggcuguuucuaaauucaguuuauuuugauacuuuaauggcagucaaagccuggaucaaaauggaagaauuuggcugcacuuuc

SEQ ID NO: 4193956 - RNA, 68 nt, Human
gaggggagcuaacaccagagcccagguccccagcuccccacccagggcuucacugcuuggcuccaguc

SEQ ID NO: 4193957 - RNA, 59 nt, Human
gaggggcagcagaggugcgggcuuggcuugagccaggccacaaccacccugugcccagc

SEQ ID NO: 4193958 - RNA, 105 nt, Human
gaggggcagcuaggaucauggccgcagcucccagaggggagcccccauccuccaggccgucuuaccgagccugcuccccagccugcgccuuuccugacuucccuc

SEQ ID NO: 4193959 - RNA, 94 nt, Human
gaggggccgcuuuuaaauacaagccuacuccugucguuggaccagaacaaagaccuacuggccagaagcacaugagaggugagagucgcccuuc

SEQ ID NO: 4193960 - RNA, 83 nt, Human
gaggggcguccagucugcaugaggacucagagcuucucaggcagagagccaucugagccaucaugugggccauaacgugacuc

SEQ ID NO: 4193961 - RNA, 72 nt, Human
gaggggcuagaaauucuguccugaaugccauugcuuaaguauugugguuucuugauggagaaccucccccuc

SEQ ID NO: 4193962 - RNA, 67 nt, Human
gaggggcucaaagugugcagggaagguaggcccuuucccugguuccaggcuauggucaaagcccauc

SEQ ID NO: 4193963 - RNA, 63 nt, Human
gaggggcuucagagacagcaaccaggacaggccgccuugccaacuaugcugugcucugcccuc

SEQ ID NO: 4193964 - RNA, 66 nt, Human
gagggggagagguuuauuucauuaagauccauuaucuuugaccugaaaucagaacccuuaccucuc

SEQ ID NO: 4193965 - RNA, 66 nt, Human
gagggggagaugugcacacacuuucgugcaaacacacacaugcagugacuuggccaucucccuugc

SEQ ID NO: 4193966 - RNA, 68 nt, Human
gagggggcucuguccacguaggugccggcacaagcugaggacaugagugggacagaggaaccagccuu

SEQ ID NO: 4193967 - RNA, 76 nt, Human
gaggggggugcccugaugacagagcccgugucuccuccaucagacugggcucacuggggcagggaccgucucccuc

SEQ ID NO: 4193968 - RNA, 70 nt, Human
gagggguguggguggcuggaggagcugauggaauuaauacauuccuggcaguucagcccccuaacccuuc

SEQ ID NO: 4193969 - RNA, 57 nt, Human
gagggguucugggcuaggaacccggacacguagguccaacccagcuuagcgccccuc

SEQ ID NO: 4193970 - RNA, 65 nt, Human
gaggguauuacauuucauuucaugcuugacuuaaucaaaacuggggaaaugaaauguacaccuuu

SEQ ID NO: 4193971 - RNA, 58 nt, Human
gaggguccccaugcagagcucaggagaagaagcuggaaaggugcaugucgggacuuuc

SEQ ID NO: 4193972 - RNA, 85 nt, Human
gagggucguggagccugagaccuggggaggggccagugcugcuguucaaauggcuccuuuccgggucuccagcuccaugaccuuc

SEQ ID NO: 4193973 - RNA, 63 nt, Human
gagggucuggaguagaugagucauguugcaagggaauguggagaacuucuacaccagacccuu

SEQ ID NO: 4193974 - RNA, 55 nt, Human
gagggucuucugcaaaugcacacugauaacaggaccaggcagcagagagacccuc

SEQ ID NO: 4193975 - RNA, 129 nt, Human
gagggugagaagagcuccagcccaccauuaggccuuugcugccucccccauggcuggaagggcaggugcuuuguuuuugcugggugggggaagguugcggcuuuccacugggccuccucugaugccuuc

SEQ ID NO: 4193976 - RNA, 85 nt, Human
gacuugucucaguuucucaccucuucagaguccuaacauguuacguguuauacuauuuagagguacagauuauaaagacugaguc

SEQ ID NO: 4193977 - RNA, 68 nt, Human
gacuugugagguuaauuuccucaucuauaaaauaaggaugauaauaauaagauuuaccucauauaguu

SEQ ID NO: 4193978 - RNA, 63 nt, Human
gacuuguggccacgcagacccagguuccaugcccagcucugccacuguggccaugggagaguc

SEQ ID NO: 4193979 - RNA, 67 nt, Human
gacuuuaugaagagaugaccaaugggcuauagacugaauuucagacaauggucagauuucagaaguc

SEQ ID NO: 4193980 - RNA, 75 nt, Human
gacuuuauugcuccuuuauuuucucucgugugggggggucuguucagcacggucagggugggggagugguggguc

SEQ ID NO: 4193981 - RNA, 55 nt, Human
gacuuucugagucaaagaaaggauuuggguccuauccuaaaggcaacaggaaguc

SEQ ID NO: 4193982 - RNA, 55 nt, Human
gacuuucuuaggcccccuaauacuugacuuagaucugguuugggccgaggaaguu

SEQ ID NO: 4193983 - RNA, 78 nt, Human
gacuuugaaccuuaauuaguguuguccauugcccuccaaaaagccagugccagcaguguuaaugcgaguguucauauc

SEQ ID NO: 4193984 - RNA, 72 nt, Human
gacuuuggccaagggcucuuuaggcugagaagucuucaguggcgacuggcaaggagccuuagggacacaguu

SEQ ID NO: 4193985 - RNA, 92 nt, Human
gacuuuuaauccauagucacaugucagaauaagugcaugguauaugguuuauuacaucaguugacaugugaguauguaacauugaauuuguc

SEQ ID NO: 4193986 - RNA, 130 nt, Human
gacuuuucagagcuugugguacggggagacaggcaggacaggcaugugcucuaggcuacagggaugcgacaaguaguacuggcucuggaagcacuuuuccuuccuuucuucucucugccucugaagcguc

SEQ ID NO: 4193987 - RNA, 60 nt, Human
gacuuuucuugcaggcuccagguggcagugagucagccauaaagcucguucaggaaaguc

SEQ ID NO: 4193988 - RNA, 84 nt, Human
gagaaaaaauaucgaugagucacagaagguuuugaugaaagcacagauuuuauuccacuuagugacucauuugugacuuuucuu

SEQ ID NO: 4193989 - RNA, 61 nt, Human
gagaaaaagcaaaauauacucagaaaaaacauuccuuuucgugaguggguagcuuauucuu

SEQ ID NO: 4193990 - RNA, 58 nt, Human
gagaaaacuuggccgcauccaccggggcccugccuccagucggccgcugccgagucuc

SEQ ID NO: 4193991 - RNA, 71 nt, Human
gagaaaauuguggugaagcauugagaagucacuagaagcucugaacgugacuccauucuucacacuuucuc

SEQ ID NO: 4193992 - RNA, 113 nt, Human
gagaaacaugaaggacauacuuuuuagugcuguuauuggucauuuuaagcucagugugggugaaaugauaucugauaacaaauaagaaguuuguguguguccuuucagcucuc

SEQ ID NO: 4193993 - RNA, 58 nt, Human
gagaaacccaaaggcaggaagaggguuaaaggaacucuuggccacucuugguguccuc

SEQ ID NO: 4193994 - RNA, 82 nt, Human
gagaaaccccuugugcaugcauacguaugugucuucauucuccuaugugaacauacagugagcaguggacugcuuguuucuc

SEQ ID NO: 4193995 - RNA, 98 nt, Human
gagaaacugggauauagcuggugcaggcaccucguggaguggaagaacugccaccucccauccccaagguauucugccucaaugucuucccucuucuc

SEQ ID NO: 4193996 - RNA, 91 nt, Human
gagaaacuuuuucaaacuuugggccuaaguacuguugauuugaggaacggaugaauaauuuuagcucagaguugugaagacagccauucuc

SEQ ID NO: 4193997 - RNA, 110 nt, Human
gagaaagaccucugaccacacaguucugucuagucccaacagcuuacaaggaaccagaccggucccugcgguguuuguugagauaaaacaaggucaggguuuggcuucuc

SEQ ID NO: 4193998 - RNA, 57 nt, Human
gagaaagagacguaacuuuagggcuugccaagcccugagaggcaaugacucuuacuc

SEQ ID NO: 4193999 - RNA, 62 nt, Human
gagaaagagacuauggugucuaugaauaucacucacuuucagggauccuauagcuuauuuuc

SEQ ID NO: 4194000 - RNA, 58 nt, Human
gagaaagcccaggagcagcacuguugagaggccagcucaggagucccugugcucucuc

SEQ ID NO: 4194001 - RNA, 57 nt, Human
gagaaagcuucuuucccacaggcucccagcaagggugugaaagcaagucuaguucuc

SEQ ID NO: 4194002 - RNA, 128 nt, Human
gagaaaggaagaaguugaugugguagaaauuggggagaugaauugauguuggacagaugaccaauaggguuuguuacaagguuuauucagaauauuugacauuuuuuaauauuuauaaauuccagcuu

SEQ ID NO: 4194003 - RNA, 65 nt, Human
gagaaaggaaugguguccaaccucugccagucccaggaguggagcaggucggcaccauuugucuc

SEQ ID NO: 4194004 - RNA, 85 nt, Human
gagaaaggaguuugaauuuuauuccauacuuggaaauuauuugagacguuaagcauggaagugaaauaaucugacuuacauuuuc

SEQ ID NO: 4194005 - RNA, 80 nt, Human
gagaaauagacaaauucacaauuauguugggagacuuugcuucagagucccacaauuauguugggaaacacucuuuucuc

SEQ ID NO: 4194006 - RNA, 94 nt, Human
gagaaauauggaauuauggacuuugagagcugggaaauguuagcuucucuagucaagaguuagcuaauagacagcauuugguccauuauaucuc

SEQ ID NO: 4194007 - RNA, 68 nt, Human
gagaaaucaugaggccaagaaaagcuggguggcuuacucgaagucaucaguuuggucaaugauggguc

SEQ ID NO: 4194008 - RNA, 89 nt, Human
gagaaaugguuugagcaaaauaaauucugacaaacccaaaagaucacugguauuugucuuaaaucuuguuacugugcaaaucuuuuuuc

SEQ ID NO: 4194009 - RNA, 62 nt, Human
gagaaauuuugaguggcuuucuuaguagagauaauaacaggcuucccacucaguaauuucuc

SEQ ID NO: 4194010 - RNA, 75 nt, Human
gagaacuguagugcaagguuuugccaacuuuuugaccagaauccucggugaguaauaaauuuugcacugcagcuc

SEQ ID NO: 4194011 - RNA, 78 nt, Human
gagaacuguucuuuugcuucuaauuaaaacagucagggguauuacugauuaaagguggggaagcagagaacuguuuuc

SEQ ID NO: 4194012 - RNA, 108 nt, Human
gagaagaaaauucauagagaaggggaaagaggcaggaaacauggauuuauuucagaaauuuuguagguuucugcuguccuccuucuccccugcuaccuacuucugcuc

SEQ ID NO: 4194013 - RNA, 117 nt, Human
gagaagacagugauggacaugcagugucuccagccuugaugacucaggaggaggagauggaacagcuccccucaaaagcucucaggggaggucacagcuguguccucaucuggucuc

SEQ ID NO: 4194014 - RNA, 81 nt, Human
gagaagacucucaauggcuucuuuuugguauaaugcucaaguauacugcuaaugggaaugcuaaugggcagagccuuucuc

SEQ ID NO: 4194015 - RNA, 64 nt, Human
gagaagagggcucgauuuggcaaaaugaccagcucucgucauguuccagauacgccuuuuccuc

SEQ ID NO: 4194016 - RNA, 84 nt, Human
gagaagaguccacuggcagugagucccggagaggcccgccugcagcagcguggcaucuuccgcacccacuuccugcucuuucuc

SEQ ID NO: 4194017 - RNA, 66 nt, Human
gagaagaugauuucagcuuuggauaugucaaguuggugcuagauauucaaguggaauuauucucuu

SEQ ID NO: 4194018 - RNA, 83 nt, Human
gagaagcaagggagagcacaguccucacauccaacuaaagguucccuaaggugcagggcuguguuugcacccucugccugcuc

SEQ ID NO: 4194019 - RNA, 75 nt, Human
gagaagcacuggcuccucaguauuccacuuuucuucaaggaaggacacugcugaggaucagaugacaugcagcuc

SEQ ID NO: 4194020 - RNA, 78 nt, Human
gaguagaagauugccagauaggcaugaaaaguaggagaauaauaaaguacuaagcacguguauuuggcagaacuacuu

SEQ ID NO: 4194021 - RNA, 74 nt, Human
gaguagaaucugggaaaaggugacucauuugaccugaacugucuccacugauaccuuucccugggagacugcuc

SEQ ID NO: 4194022 - RNA, 79 nt, Human
gaguagaccaaguucacaucccagaaagagcauuccugugauggaggggcaacugcauugugaauuaugaucaguauuc

SEQ ID NO: 4194023 - RNA, 96 nt, Human
gaguagaugaaaucagauuuagaguggggcuuggaauucucugcucaaguccacagaaaucugaaagcccuaguuuguaaucucuaauaucugguc

SEQ ID NO: 4194024 - RNA, 59 nt, Human
gaguagcagaggccccuuucccaggaggauaaccugggcuuauggagggcuuuguacuu

SEQ ID NO: 4194025 - RNA, 81 nt, Human
gaguagcaugcagugaaauugauauccaguuuuuuaaaacuuucauaugaauugguaugaugaucacuagcagauuuauuc

SEQ ID NO: 4194026 - RNA, 72 nt, Human
gaguaggaauuccagaguauugguagcuauaaccacuuuggguucccugccauugcuucuggugccucauuu

SEQ ID NO: 4194027 - RNA, 84 nt, Human
gaguauacgauggccaggcaggaggcaugaagcuggcaaagccacuuuggcaccuucugccuauaagacagccucuguuuauuu

SEQ ID NO: 4194028 - RNA, 66 nt, Human
gaccgcaggguggaagcuguagaguggucagcauuuggaugccacauacugcaaucaccccugguu

SEQ ID NO: 4194029 - RNA, 74 nt, Human
gaccgcauucccacuuggcaggauguugcuggaggugaauggcugccauccuucuaagagggacguaugcuguc

SEQ ID NO: 4194030 - RNA, 81 nt, Human
gaccgcuguaaauaaagucaucuuuacaucuuugccagaacccauuugucaguuguauguggcuguaugagacagugaguc

SEQ ID NO: 4194031 - RNA, 66 nt, Human
gaccggcuuucuccuugccuuagucuucuaugccaauaaagaagaaaggcagggaugaggauuguu

SEQ ID NO: 4194032 - RNA, 57 nt, Human
gaccuacauggaugcacagaaguggcuuagccccuauucucaguguccauguuaguu

SEQ ID NO: 4194033 - RNA, 66 nt, Human
gaccuacuagcaaaaagcaggguugauauauuuuucuguugguguguuaaauguuuugcuaguguc

SEQ ID NO: 4194034 - RNA, 61 nt, Human
gaccuagauuugcaugccuacaccacuaccuaguaguggugcccuuugauaaauuuauuuc

SEQ ID NO: 4194035 - RNA, 95 nt, Human
gaccuauagaacaagccuguguuguuuucagcuauuacauuuguggucauuaguuauaguagcaacaagaaacaaauacacuggcuuuucagguc

SEQ ID NO: 4194036 - RNA, 81 nt, Human
gaccucagagccuggcauccucccucaagcugaaggccaauuugcccuucagugaccuggaugccuguccaggcucugguc

SEQ ID NO: 4194037 - RNA, 63 nt, Human
gaccucaggcuucuguaauuaaggaccaccaaaaaccaucuccauuuuguuuagucugagguc

SEQ ID NO: 4194038 - RNA, 67 nt, Human
gaccucaucugaacauaugcaaagacuuuauuuccaaauaagacuacaugcguagguucgagggguu

SEQ ID NO: 4194039 - RNA, 65 nt, Human
gaccuccugcucaauuccggcacgcuggcccucacucagacggcacugcgccugauugguagguc

SEQ ID NO: 4194040 - RNA, 85 nt, Human
gaccugacauccucccaagguugggcccugcucugaguugcuguggggacacaacuccugagguccccugugguaguaugugguu

SEQ ID NO: 4194041 - RNA, 69 nt, Human
gaccugacauguuguuaauuguggaccuccauuuagaguaaaucuacaaagaagaauuaaugucugguu

SEQ ID NO: 4194042 - RNA, 81 nt, Human
gaccugaugacgggguguaccacucuacuaaggguucccaacaugaaggugagggggccccugggaauucugugauugguc

SEQ ID NO: 4194043 - RNA, 129 nt, Human
gaccugcaggugugggaaugugugauccagugcuggaaggagccgugcagcaaggcuuccuagguucucagcacugugcuccuuccuuagcacccggcugcucauauuacuccacgacuccacacccuc

SEQ ID NO: 4194044 - RNA, 60 nt, Human
gaccugccacaggugcaagaaguugcagucaaaugauuaccaacaugcaccugugugguc

SEQ ID NO: 4194045 - RNA, 106 nt, Human
gaccugccaguuguccaguguuaaguuaucuguguuguuaucagaaucaaacauuaaaaacauacagccuauucuuaccauuguuuuggagaacugagaaaggguc

SEQ ID NO: 4194046 - RNA, 74 nt, Human
gaccugccucgauuuuccugucauuccugugugccagcaucacacacagugauugggguaucugcagcuuuguc

SEQ ID NO: 4194047 - RNA, 89 nt, Human
gaccugcucuaagcugguggagaguaagaaagcugggacuucauuauucaagguuuauucaguuuagaagggaaaauaauuagcaaguc

SEQ ID NO: 4194048 - RNA, 76 nt, Human
gaccugcugggcaauaugcugggccuggaccucugaaaggacaacacccagaccguggcccgugcccacacagguc

SEQ ID NO: 4194049 - RNA, 77 nt, Human
gaccugggaugcagaggcagggcuggggagcaggcucugucuucuuggcugcaagucucugugugacaucccaaguc

SEQ ID NO: 4194050 - RNA, 57 nt, Human
gaccugguuucaggaacauaaucuauuugucauaauuugaguuucugaaaccauguc

SEQ ID NO: 4194051 - RNA, 69 nt, Human
gaccuugaagaugguagcaauuuccucucugacucaugcauaggaggagauuccaacauuuucucuguc

SEQ ID NO: 4194052 - RNA, 83 nt, Human
gaccuugaaugagauuaauaauaucgcuccuuuuuuugagaagauuaaaaucucaucagagcgauaaauacuuauaaaggguu

SEQ ID NO: 4194053 - RNA, 79 nt, Human
gaccuugaaugccuugcagacauuccagagcuuuuccccuugggugauggggagacguggaaggucuagaggucagguc

SEQ ID NO: 4194054 - RNA, 78 nt, Human
gaccuugaauuuguacugaccaauuauuugaaagccuuuguuaaaaagcaucagauuuuuagucauuuaagugugguu

SEQ ID NO: 4194055 - RNA, 78 nt, Human
gaccuugagaaggcuaguguugaugggaccugguagugauauucagugcagguaagagaggcuggcuuccacagaguc

SEQ ID NO: 4194056 - RNA, 77 nt, Human
gaccuugauuuucucuuaugggauagagaggggugggaauggcacacccaucccuuccucauaggcagaaggggguc

SEQ ID NO: 4194057 - RNA, 99 nt, Human
gaccuuuagucagugaaaguagcagguggucuguugcugcugccauccccaggcggaauacccuuccugcaguagacaacagccgaugucaccaagguc

SEQ ID NO: 4194058 - RNA, 84 nt, Human
gaccuuuugauuacagugcaaguaucuuaguuccauugccuuccugaaagaucaauaacuuugauauuuugcgguaagaagguc

SEQ ID NO: 4194059 - RNA, 80 nt, Human
gacgaaagaaagauuuuaucuuugugugcaguauuuuaucuugaaaauaugcccaaaugaugagauuauauacuuuuguu

SEQ ID NO: 4194060 - RNA, 70 nt, Human
gacgaugcgacagaguggggacuucucaggcuggacagggcccuagaagccagucgcucucccgcagauc

SEQ ID NO: 4194061 - RNA, 65 nt, Human
gacgauguagacaguuguguagguagcaauggucuggcggaccuagaacacaaccuauauuaguu

SEQ ID NO: 4194062 - RNA, 69 nt, Human
gacgcagggaggaugggcuguuuugcccugaacccuaaggugcaggguaggggcuccuucucccuguuc

SEQ ID NO: 4194063 - RNA, 71 nt, Human
gacgcaucagcuggcuauccuauugcauacuuucauuggcacugcaaucagguaccauuugauucuagcuc

SEQ ID NO: 4194064 - RNA, 68 nt, Human
gacgcaucaggaggcgaggagcuguggacugagaugaaaacacaggacuguuugcaagccuauguguc

SEQ ID NO: 4194065 - RNA, 110 nt, Human
gacgcaugaaaugaugggcauguuaguccuuuuguuauugugagaguccugcauaguuuguucugugacucacuuaauuuacaagucccuagccccacauuauugguauc

SEQ ID NO: 4194066 - RNA, 71 nt, Human
gacgccagcagaguugguuucugguaaguccucucuccuuggcuugcagaugaccacauucuugcuguguc

SEQ ID NO: 4194067 - RNA, 76 nt, Human
gacgcuuccaaaaccugcucuguaaggucagaaaaggaauuugucacuugacccucacagggcagucaggaauguc

SEQ ID NO: 4194068 - RNA, 96 nt, Human
gacgcuucuccccuccccuccuagaggaaccccagggcacgccggaaugcgugugguccuucaggguccauuagggucaaaagugggaggggcguu

SEQ ID NO: 4194069 - RNA, 68 nt, Human
gacggaaaguguuuacuuaaagucauggccaaauggcuagggagaguuaagauaaaucauaagcuguc

SEQ ID NO: 4194070 - RNA, 62 nt, Human
gacggacucuuggcaaucuauacugucuuucagccaaaguguagcuuuauacaagaucuguu

SEQ ID NO: 4194071 - RNA, 74 nt, Human
gacggcgcugggucggccuggcgcgcccucccgcgcccacgggcgcuaggcuaggucugugcgcagccgcuguc

SEQ ID NO: 4194072 - RNA, 100 nt, Human
gacgguaaagcuggaucacuaagcaugagccagugcaacacagugcaagccucuaguuugacuguuaagacuuggcucugccguggccuagcuguucauc

SEQ ID NO: 4194073 - RNA, 70 nt, Human
gacguagaacucacagauguucuccuuuagguuucccuauugauuccuugagagaagucugugccuuguc

SEQ ID NO: 4194074 - RNA, 96 nt, Human
gacgucggggcuguucaggcuucugcuguauuaacacuugucuucagaaagaaagcaguggaguuuggugcagugagcacaagcagccuacuaguc

SEQ ID NO: 4194075 - RNA, 73 nt, Human
gacgucucuggaguguguguauucagcuuucucauucucuuugaaaucuagcuauuugcacuccaaagaaguu

SEQ ID NO: 4194076 - RNA, 61 nt, Human
gacgugcucauauauuccucacauagcuguuauuaacuagcugugugaauuagggcauguu

SEQ ID NO: 4194077 - RNA, 60 nt, Human
gacguggcucugucagguugcgccugcaagaggcugaccaaggccugugcagagcccguc

SEQ ID NO: 4194078 - RNA, 66 nt, Human
gacgugguccuuggcuuucuggagcuucuauucaaguagaaggagacagacagucaagaucauuuc

SEQ ID NO: 4194079 - RNA, 78 nt, Human
gacguuuaguaucacuuagccucauccacuggcugccaggaugacaguuaauggaugcggcugcgugaccgugauguc

SEQ ID NO: 4194080 - RNA, 85 nt, Human
gacguuuuucaucacuucacacuuuugcaguguuugcuacaaucaagacacugugcuuagaugcugaacgugaugcaaaggaguu

SEQ ID NO: 4194081 - RNA, 86 nt, Human
gacuaaugauguugaacaucuuuucaugugcauguugaguacccguguguuuucuuuggagagaugucuguucaagguuauuuauc

SEQ ID NO: 4194082 - RNA, 100 nt, Human
gacuacagccccggaccuugugagagcucagcugcccugggcccuauccucuccuggcccaggaaccuaccagcucgaguggcucccguggccacgaguc

SEQ ID NO: 4194083 - RNA, 62 nt, Human
gacuacccagggcaaaugucuucccuucccuuccugaagccacaggaaagcacccuggaguc

SEQ ID NO: 4194084 - RNA, 68 nt, Human
gacuacuucccagaacaauguaggcuuuacacccaagagacaagccucaggacauucaggaagaaguc

SEQ ID NO: 4194085 - RNA, 87 nt, Human
gacuagaguuucuugagagauauacuacugaaagaagcuaucuguauuaaaauucaguauguguaaacuacuuuaaugaaccugguu

SEQ ID NO: 4194086 - RNA, 79 nt, Human
gacuaggcucaaugaaaggaagaacucuggcaggccaguaaaagacaucuaccuuucauucaaacagagcccacaaguc

SEQ ID NO: 4194087 - RNA, 60 nt, Human
gacuagucagucccuacuaaaguauuuccaggacuuuuggaaacuuaagggggagauguc

SEQ ID NO: 4194088 - RNA, 103 nt, Human
gacuauauugggggauuagagguggguucugaagauguuguggaaugcuguuuccccaugguuuccaggauagcuuucaggaauccuuuucuguagaauaguc

SEQ ID NO: 4194089 - RNA, 55 nt, Human
gacuaucauuaaauauuuuaauuugcuuucgcuaggaaaucaguuaaugaugguu

SEQ ID NO: 4194090 - RNA, 90 nt, Human
gacuauccaguuggcuaguaggugaguagugcugaagauacuauucugggaggcaaucauuuaucucugguuauugguuuaagaaugguc

SEQ ID NO: 4194091 - RNA, 84 nt, Human
gacuaugggcaaaacuauauacauggaaagcuauuaucauuauuauuauucuauguggauauagaacugcuuacagacaugguu

SEQ ID NO: 4194092 - RNA, 96 nt, Human
gacuauuagguugaugcaaaaguaauugcaauuuuaccuuucuuuacuuuuaaugggaaaaccgcaauuacuuuugcaccaaccuaauauuaaguc

SEQ ID NO: 4194093 - RNA, 64 nt, Human
gaucuuuuccuuucugugucuaauaggauauuucuacaaacaagaugcuggauggaaaaugauc

SEQ ID NO: 4194094 - RNA, 93 nt, Human
gaugaaaacaguaaucuugccagucuccaaaucagucugaaugguaucauuuaccuugaugaggggaucaagguagcggaugcugugagcauc

SEQ ID NO: 4194095 - RNA, 59 nt, Human
gaugaaaugagauagauaaucaggcagguccgauccauugccuggugcauucauucauu

SEQ ID NO: 4194096 - RNA, 66 nt, Human
gaugaaggaagccuugcucuugaaaaaguuguauuugguguaacccaggagcagguuuccgaaguc

SEQ ID NO: 4194097 - RNA, 57 nt, Human
gaugaaggccuuguccugaucccuuggaaacacagagcaucacagacgugccucauc

SEQ ID NO: 4194098 - RNA, 79 nt, Human
gaugaauuuauagucauucugcagaaauauaaaggaacuagaucuccuaauggccuuagugaugauuaauacguucauc

SEQ ID NO: 4194099 - RNA, 101 nt, Human
gaugacaaauacaaggaaggcaaaguauuaaguauuaaguuuggcuauaaaagcuugguauagcuaaaugcuaaaugcuaucugcccuugguguuugcguu

SEQ ID NO: 4194100 - RNA, 72 nt, Human
gaugacacugcucuuaugaccaaaggaaugugagcucguauauucuuuuagaauuuccuaagguagguuauu

SEQ ID NO: 4194101 - RNA, 65 nt, Human
gaugacauggcuagcacugugacccugaaugaagccagcauaccuguccaguguagcuggucauu

SEQ ID NO: 4194102 - RNA, 82 nt, Human
gaugacauuauguguguuucagaagccagguguaaagagcacuuuuccauacauuuuauaucugaguuaccaaugccucauc

SEQ ID NO: 4194103 - RNA, 63 nt, Human
gaugaccgugguagccaaguaaguguccaucagcagaauacaaggcaaauccaugaugucauu

SEQ ID NO: 4194104 - RNA, 100 nt, Human
gaugaccugcuuaaaggcgauaaggcaguguuuuaaggaugaccacuaaaucuuuguuuugccaacacuacuuauaaaauguuuuacaaaugguuuaguc

SEQ ID NO: 4194105 - RNA, 62 nt, Human
gaugacucuuuguggaugccgcagugggcaacagcucuuucugugacuugccaaaggucauu

SEQ ID NO: 4194106 - RNA, 129 nt, Human
gaugagaaucuccugaggguguuuguuaaauauuacaaguuucuggcuucaucccagacccauugaauaagaagcucuaggaggaccaggaaccuguguuuuuaauaagaggcccugauaauuccuauc

SEQ ID NO: 4194107 - RNA, 58 nt, Human
gaugagaauguuuaucaaaugccuaccaugcaccaggcaauugauaaacaauuucauu

SEQ ID NO: 4194108 - RNA, 61 nt, Human
gaugagacagaauagcccaaggucugauccaagggacaucuggugcucuuuugucuucauu

SEQ ID NO: 4194109 - RNA, 61 nt, Human
gaugagagacgaggcagccauggagaggagacugcagcugccuggcuuccugacucucauc

SEQ ID NO: 4194110 - RNA, 56 nt, Human
gaugagauaguuaaauagcauguuuauuuaauaagcauguacaaugagugucucuc

SEQ ID NO: 4194111 - RNA, 113 nt, Human
gaugagcuacuuacaguccagguugugcugucacauguccggugucuuuugguacucugaguuuguauaaggaagcuguuagacaugcauagugcagccuggcauggcuuauc

SEQ ID NO: 4194112 - RNA, 78 nt, Human
gaugagcuggaagugagaaguuuccucagaaagggcugaaaggguuggcugagaauuuuuuuucauuucauccucauc

SEQ ID NO: 4194113 - RNA, 78 nt, Human
gaugaggacugggggggucugggaugggugccggggacaugcaucuggagccagcccaggccccucuggcaauucguu

SEQ ID NO: 4194114 - RNA, 75 nt, Human
gaugaggagguucacuguuaugcguaccacugucacucaacacuugauuuacaaugcagugaccuccuuuaaauc

SEQ ID NO: 4194115 - RNA, 56 nt, Human
gaggggccucagccuccuggucaugaaagaguccuggguagaggcagagaccccuc

SEQ ID NO: 4194116 - RNA, 72 nt, Human
gaggggccugcccucagcugccaugcuccccagggacaggcggcggacaguggcagcugagugcacccccuc

SEQ ID NO: 4194117 - RNA, 58 nt, Human
gaggggccuggcgaggacauguagaaagacugcguuuuccuuuucaaucgggcccuuu

SEQ ID NO: 4194118 - RNA, 80 nt, Human
gaggggcggagguaggggccagaaagacuuagaagaugucccauauguuuaaugucuuuggccuuuaauucugauuucuc

SEQ ID NO: 4194119 - RNA, 80 nt, Human
gaggggcgugaaaaugaacacaucagaagccaguguugcuugggcgcaguuucagagguguucauuuucauuggcucuuu

SEQ ID NO: 4194120 - RNA, 61 nt, Human
gaggggcuagcuaggcugggccaggaucccuguauaaauggcccaggagcugugccccauc

SEQ ID NO: 4194121 - RNA, 76 nt, Human
gaggggcugggccacuccagaugcccacuugaucaucuuugcuggugcaguauauggagggcucacccacaagcuc

SEQ ID NO: 4194122 - RNA, 65 nt, Human
gaggggcuguggagcucucugguccaaccauuuccaguuauagauagagagaccuaggccuaguc

SEQ ID NO: 4194123 - RNA, 81 nt, Human
gagggggagaggggaacuuguugcuugcaacccauuggccaucaauggcugagugaccagaagucccccuccuguacccuc

SEQ ID NO: 4194124 - RNA, 55 nt, Human
gaggggggcugucagggcaagcccagggaucacugaugcugcccuagcuccccuc

SEQ ID NO: 4194125 - RNA, 65 nt, Human
gagggggugcauuguuuauuugaacaaauaaaacaauacuuugaguuuaaauauauuucccccuu

SEQ ID NO: 4194126 - RNA, 64 nt, Human
gaggggguggucacgcuuuccagggucuuuucuguuucugacaggcugugauuccaccacucuc

SEQ ID NO: 4194127 - RNA, 55 nt, Human
gagggguaccuauugugggggcucaggaauacuagcucuggccuacuguucccuc

SEQ ID NO: 4194128 - RNA, 74 nt, Human
gagggguccauacggcgcuguucuggauucccguuguaacuuaaagggaaacuuucacaauguccggagcccuu

SEQ ID NO: 4194129 - RNA, 66 nt, Human
gaggggucucagggcugagggcagugggcagauauggccccugcaucccagucuuagcaaauccuc

SEQ ID NO: 4194130 - RNA, 99 nt, Human
gaggggugagccucaggcagaauggagggcgcuuagauggagggggcagugggcucuccgcauugguggagcgcccucggugugccgggcucagcucuu

SEQ ID NO: 4194131 - RNA, 128 nt, Human
gagggguggggccggccucaacgcagcagugugcuagcaagaacuggggacauuuuuacccugccaucccaucaucuguucuggcuacacaaaaugagugugaauuaugggggccugcugagccuuuc

SEQ ID NO: 4194132 - RNA, 80 nt, Human
gaggggugguucugagaugaggaggaaaaagcuauuaguuggcuuuuugcaagaguuucucaucccagacuuagcuccuu

SEQ ID NO: 4194133 - RNA, 58 nt, Human
gaggguagguacauuauuagaugcauguugaauucaacugaauuaugugcuuaccuuu

SEQ ID NO: 4194134 - RNA, 93 nt, Human
gaggguauaaaggacuucaguuucuaaagauguuccuaaaugcuccguggcaucugcagcaggaugucgggagcuggaauccacugugcucuc

SEQ ID NO: 4194135 - RNA, 66 nt, Human
gaggguauccuauaguccuuagaggggccuuagagacucuuucuuauuggauaaaaggaaaccuuu

SEQ ID NO: 4194136 - RNA, 71 nt, Human
gaggguccuggcuguggucugauaggauuuacaugggagaugauaaaccugcaacuauagccaccauucuc

SEQ ID NO: 4194137 - RNA, 55 nt, Human
gagggucuccugccccuggcucugccuugagugagugugggugagggaggcccuc

SEQ ID NO: 4194138 - RNA, 69 nt, Human
gagggucugagaagucauuugaccaccuagccugaaaccagcccuaggcucaggugacuccaagcucuu

SEQ ID NO: 4194139 - RNA, 67 nt, Human
gagggugacgguggggguagcaaugguguggaggacauaacacugcuaaaucuccaucgauuacauc

SEQ ID NO: 4194140 - RNA, 77 nt, Human
gagggugagaccagauuucaaaguuuuccuucuucuagaacuuagaagaaggaaguguggacaucacuaucaucauc

SEQ ID NO: 4194141 - RNA, 77 nt, Human
gagggugccagcaugauuggugucuggugagggcucucuuccuggcuugcuaguagccgccuucuugcuguauccuc

SEQ ID NO: 4194142 - RNA, 130 nt, Human
gagggugcccccgagacagccgagcguuuccagagguagccgagugcaaucgggucggcgagggauccgagacugggcucggcugggcuuagagacgcccgagcgcuuucggaaauggccgaacacucuc

SEQ ID NO: 4194143 - RNA, 64 nt, Human
gagggugcugucaggaagcugggcauccagggcugcaccuggaaaccaagcuggcagcggcuuu

SEQ ID NO: 4194144 - RNA, 77 nt, Human
gaggguggagguccaagaucaagggcagguugguuucucuugaggcuucucuccuuggcuugcagacggccacauuc

SEQ ID NO: 4194145 - RNA, 58 nt, Human
gaggguggcauacaacauagaggcuugaaccaaaggccucugcaauguugucacacuc

SEQ ID NO: 4194146 - RNA, 119 nt, Human
gaggguucugaugguuuauucauuccuguaauacauauucauugaacaccuacuacaugccaggccccgugcuaggugccaggaauacuacaggaguagaaaaaacagacacuacucuu

SEQ ID NO: 4194147 - RNA, 122 nt, Human
gaggguuucuucaagaauacuucaguugaguggaaucuugacccucaaauaguugccuagguuagcaggaccugaggcaaucccuaggguaaggucuggucagauaaguuaaagccgccuuc

SEQ ID NO: 4194148 - RNA, 86 nt, Human
gagguaaauaugugucuuguaaaagcuuugugugaucagaauauuuugguaauuauaaaauguuuuugaugauacacauuuaacuc

SEQ ID NO: 4194149 - RNA, 78 nt, Human
gagguaacuugcauuuaaauauugaauauucaaucaauaauuaaagugauguuuaauaaggaaaugcaagacagccuu

SEQ ID NO: 4194150 - RNA, 96 nt, Human
gagguaaggaacuugccagaaguuaugcagcugaggguaguggagccaggauuugagcccaggcagccucacugcaguccuugaguuccuaaccuc

SEQ ID NO: 4194151 - RNA, 129 nt, Human
gagguaagucuucuccugguguuuagucaggaugccuuagaguguguuguguuguauuaaaugauggaugguguaacaaauacccuugaaguucucacuggcuuaacauaaagaguuaguuucuuccuu

SEQ ID NO: 4194152 - RNA, 90 nt, Human
gagguacagccaggacagggcagcucgcuccgagauuuuuggcucucgaaggccuugagcgcugugguucugcagaacgcugucugccuc

SEQ ID NO: 4194153 - RNA, 113 nt, Human
gagguacuaacgcacuacauuuuugaauuacuauugauugacaugucucuguucaauguaaacagcuuaaacagagagugcaguuauagaaauggaauuugcaugagaaccuu

SEQ ID NO: 4194154 - RNA, 98 nt, Human
gagguagacucucgcucugucaccaggcuagagugcaguggcgcagucgcagcucacugcaaccucugccucccagguucaagugauucuucugccuc

SEQ ID NO: 4194155 - RNA, 65 nt, Human
gagguagauauacuuauuccauuuuuacugaugaugaauaugaauggaccaaaguaauuugccuu

SEQ ID NO: 4194156 - RNA, 97 nt, Human
gagguaggaaaaucacuugagcccagaguucaaggcugcagugaguuugaucauaccauugcacuucagccugggugacagagugagauccugucuc

SEQ ID NO: 4194157 - RNA, 70 nt, Human
gagguaggccgaggaagcugagucagugauucuuuuaaaucucaaauucccuuuuccuccugcuugccuu

SEQ ID NO: 4194158 - RNA, 57 nt, Human
gagguagguguaggaggccugcagguacaaauugaccaggcuguugacggcugccuc

SEQ ID NO: 4194159 - RNA, 73 nt, Human
gagguaguccuggcugcaguuuuugcagaagaaugaauaacauuuucuggaaacccucagccagugucuccuu

SEQ ID NO: 4194160 - RNA, 94 nt, Human
gagguagugauuuuuguaucaggaagccagucuaauggagauggggcuccauggaguagauuauccugaagcuggaaggacuggagaaaaccuu

SEQ ID NO: 4194161 - RNA, 96 nt, Human
gagguaugcucuccuccagcucccaggauguuggcggcagguagcucugagcugaggccuccccugcaauuguccuuggcuaaggagggccaccuu

SEQ ID NO: 4194162 - RNA, 61 nt, Human
gagguauggcauaaaucacaggggagggcauaaacucagcuucaugagaaugccaggccuc

SEQ ID NO: 4194163 - RNA, 61 nt, Human
gagguauguccugagaguuugacugcagugggaauugugacaguaacuugggauggaccuu

SEQ ID NO: 4194164 - RNA, 61 nt, Human
gagguauguguuguuuuuggauuauccaucaauguggauaaucaagagcugacuauauuuu

SEQ ID NO: 4194165 - RNA, 59 nt, Human
gagcuuccuggaugaagcccagcauaaaugucuugugcuuauccccauucuggaggcuu

SEQ ID NO: 4194166 - RNA, 64 nt, Human
gagcuucucaagagaaggacaucgaaaauucucacuuggucuauguagucucuuugggaaacuc

SEQ ID NO: 4194167 - RNA, 58 nt, Human
gagcuucugccauagagggacuuugcacccgcugcccucugucaggcugcagaugcuc

SEQ ID NO: 4194168 - RNA, 66 nt, Human
gagcuugagugcccaagcaagaggaaauuaccaauaauuuuaauaguauguggcaucucugagcuc

SEQ ID NO: 4194169 - RNA, 76 nt, Human
gagcuuggagaucucuguaaaccauaaauugaaggguauggucucuuuguaggguauagcaggagaacccaggcuc

SEQ ID NO: 4194170 - RNA, 60 nt, Human
gagcuuggccucuugaacgugggccacaauaauucagcccacaucauuucaggcagguuc

SEQ ID NO: 4194171 - RNA, 56 nt, Human
gagcuuggugcugccuguugucugccugccccugaccugaaggacaugcccagcuc

SEQ ID NO: 4194172 - RNA, 56 nt, Human
gagcuuuccacagaggcugaacauggcuucagaagccacagccucugggaaaacuc

SEQ ID NO: 4194173 - RNA, 73 nt, Human
gagcuuuggguuagauuauauuuaaauauuguuuucaacaguauaccauugugacuuugaugccccaaagauc

SEQ ID NO: 4194174 - RNA, 58 nt, Human
gagcuuuguaaaaaacuugcacaccauggucuauguggcaagucacuguguagagcuc

SEQ ID NO: 4194175 - RNA, 57 nt, Human
gagcuuuguagcaggaaggaaggggaaauacugcaaaauccauuaagcucagagcuc

SEQ ID NO: 4194176 - RNA, 59 nt, Human
gagcuuuucccgucuuucucgugcugcguucaagcacgaugcagggacggcagggguuu

SEQ ID NO: 4194177 - RNA, 102 nt, Human
gaggaaaaacaaucugaaacaugaguauauccagaaaaucaguucauuuauguaacccaagaugauuggcagauauuuucuggcuuucaugagucaauccuc

SEQ ID NO: 4194178 - RNA, 101 nt, Human
gaggaaaacauguuuucccuccauuuccuucacaugaggauuuccuugaguuuaaaauccuguguugauagagaugguuuauuuagaagagcguuggccuc

SEQ ID NO: 4194179 - RNA, 62 nt, Human
gaggaaacugaagcccaugcuucacgcucuaagcacgaguaacagagcauggguucagacuc

SEQ ID NO: 4194180 - RNA, 74 nt, Human
gaggaaagagucaaaucugaagaucgugaaauuauguucucuuuucuuccguuucaguauauuugccuucccuc

SEQ ID NO: 4194181 - RNA, 66 nt, Human
gaggaaagcaauggcugagaacacugaaagaaagaagcaauguuaggcagcaaugcuuagauccuu

SEQ ID NO: 4194182 - RNA, 57 nt, Human
gaggaacagagggcaaggccagggcucaugugcugacaccuuuuuccuucuuuccuc

SEQ ID NO: 4194183 - RNA, 129 nt, Human
gaggaacaugaggcauguugucagugaguaagaaguggcagucauuaucgcugagucagaauugauggcucuuguucguaccauggcuuagccauguuugaauuauuuguuuacuuguuucuuuccucc

SEQ ID NO: 4194184 - RNA, 63 nt, Human
gaggaaccaaucugugauauucagaaugugggaugaucuauaggauaaauggucugguuucuc

SEQ ID NO: 4194185 - RNA, 72 nt, Human
gaggaacccagcugggguugccgacugaaacaucuacacuuggccucuccaugaagcugcuuggacuuccuc

SEQ ID NO: 4194186 - RNA, 74 nt, Human
gaggaacugccagacucuuuuccaaagcacugcauuuuacauuuccaccagcaguguaugaguuucaguucuuc

SEQ ID NO: 4194187 - RNA, 100 nt, Human
gaggaagaacuuguuuuucuugcuuaagaggaagaacuuguuucucuugcuuaagagaaacaacuuguuucucuugcuuaagagaaacaacuuguuucuc

SEQ ID NO: 4194188 - RNA, 72 nt, Human
gaggaagaaguaacgaauaaacaagugauaaauaccuugguuuuuucauguuauuuuuguuguucuuuacuc

SEQ ID NO: 4194189 - RNA, 63 nt, Human
gaggaagcugcguggcauuucagagauacuuauuuuaaaacugcugguggccaugucuucuuu

SEQ ID NO: 4194190 - RNA, 55 nt, Human
gaggaaggcagccacgucaggcuggcuggccagcuccuugcagguugccuugguc

SEQ ID NO: 4194191 - RNA, 59 nt, Human
gaggaaggcuaaggggcuuagagucuggcuaaggauuucugucccucuuugcuucccuc

SEQ ID NO: 4194192 - RNA, 66 nt, Human
gaggaaggggccuaucacuuugaauuagaauaaaaguaaauaagcuggugauguggucccucacuc

SEQ ID NO: 4194193 - RNA, 74 nt, Human
gaggaagggucagggucuguaggggaaggucuggauuuggguccuggcucucuacaaaccagacauaaaaccuu

SEQ ID NO: 4194194 - RNA, 77 nt, Human
gaggaaguuauccugaagguuaacugucaguuauccugacuuucagggcuaaugagaucauaucuucugagcuccuc

SEQ ID NO: 4194195 - RNA, 61 nt, Human
gaggaaucacaucucauucaacagccuguuacaggggucugggaauuggaugugggaucuc

SEQ ID NO: 4194196 - RNA, 126 nt, Human
gaggaaucuucuguucucaagaugcuugacuuuaccacaucuucaaagucucuaccuguguaaagcaacauagucacagguuccagggauuaggauguggucaucuuugaaggacugcuguuccuc

SEQ ID NO: 4194197 - RNA, 85 nt, Human
gaggaauugaagauuucuuuaugaaagauggcugaaacuccugacagcuuuucaaauucaucuuuggagaaacuuccguuuucuc

SEQ ID NO: 4194198 - RNA, 60 nt, Human
gaggacacuggacuccuggcagcagguucugucgaccccaccugugagucuuguggccuc

SEQ ID NO: 4194199 - RNA, 78 nt, Human
gaggacagaggccuauccaguguccaucuagucucuccuagacacgacguauggaugcagggugcagccucgguccuc

SEQ ID NO: 4194200 - RNA, 83 nt, Human
gaggacagauaagucauccucagagaacgaacacaaugaaggaaauuccagccuauucauguucuccucucaggcuguaccuc

SEQ ID NO: 4194201 - RNA, 130 nt, Human
gaggacagggcuucucugguggcuuggaguccuugcugcuucacuuuuuggagacaggacagauggagcccaggcguaggauaaauaaaccaaugaaaucugagaaaacaauguccugcuacuucucuuc

SEQ ID NO: 4194202 - RNA, 69 nt, Human
gaggaccaagauaagagacaagauuuaugacuagacuauauagauaauuguuucaauaucuuuuucuuc

SEQ ID NO: 4194203 - RNA, 90 nt, Human
gaggaccagaugggggcaguuggcccagggcuaucagacaccacuggauggaggcccacacuggguagaugcaccuucccccaggcccuc

SEQ ID NO: 4194204 - RNA, 76 nt, Human
gaggacguggcauguuuugggaagucagcucugggaagucacacugggcugcuccacuaagccaucccauuuccuu

SEQ ID NO: 4194205 - RNA, 68 nt, Human
gaggacucagauaaucuuugagucuucauugguguuaccauuagaaguguucaaaggaugucuuccuc

SEQ ID NO: 4194206 - RNA, 109 nt, Human
gaggagaaacggagccaucccccuuuuaaaaucagccacucugcagcgcuuuaggccgguuuucaugccugcagacugcgagcgugcugguggggguguaucccuccuc

SEQ ID NO: 4194207 - RNA, 104 nt, Human
gaggagaaagccaggaaaugacccauuggucccuagauccagaggccacaagaaaggacaggaaaucaggugaccauggggaaaagauuucuuugcugcuccuu

SEQ ID NO: 4194208 - RNA, 55 nt, Human
gaggagaagaaugaggcuggaggggccacauggcugccccagcuccacuucccuc

SEQ ID NO: 4194209 - RNA, 64 nt, Human
gaggagacccuggagcaauaaucccuggaaauaacaggaauuucaggggcaaauccagauccuc

SEQ ID NO: 4194210 - RNA, 60 nt, Human
gaggagagaacaagaguauccugaggcggucuccugcagugcucauagcuguuccuccuu

SEQ ID NO: 4194211 - RNA, 73 nt, Human
gaggagagaagacagaagugaugauuaaugggaucuuuuaccagauuccaggaacacucugugucccuuccuc

SEQ ID NO: 4194212 - RNA, 55 nt, Human
gaggagagacagcugaacaaagaaacugcccacucuccuucugcuguuuccccuu

SEQ ID NO: 4194213 - RNA, 89 nt, Human
gaggagagaggccugacuuuccugccaaggccagaguugccccuggcuccagcucgccuggcuggaucuggguccagggcuuccuccuu

SEQ ID NO: 4194214 - RNA, 65 nt, Human
gaggagagaggggaggcgaaccagagucuuguaugggucucuggaggauccuccucgcuugccuc

SEQ ID NO: 4194215 - RNA, 64 nt, Human
gaggagagcccucacuccuucccugaaccagaggacccaggcugaggcaguaggguuuggccuc

SEQ ID NO: 4194216 - RNA, 69 nt, Human
gaggagaggccaucguuguuauuaaaaauaagaauauaaauuguuaccaaacacugagggcuacucuuc

SEQ ID NO: 4194217 - RNA, 82 nt, Human
gaggagauugacuacaaagaaacauaugagaacuuuuggggguaauggaaauguucuauaucauuauugugacaguuucuuc

SEQ ID NO: 4194218 - RNA, 68 nt, Human
gaggagccuggccccacauccagcucauucaccuuuaacucaggcuuuucauggggcugggcugccuc

SEQ ID NO: 4194219 - RNA, 61 nt, Human
gaggagcgcgggguacacgcgguggccgcagacgccgagcccugcggagccccgaggccuc

SEQ ID NO: 4194220 - RNA, 94 nt, Human
gaggagcggccaggagaaaggagggaaaccaggagcagccggcccaccugccacggccugacuggcucuucugccucauccucuucugcuucuc

SEQ ID NO: 4194221 - RNA, 82 nt, Human
gaggaggagagaugguagauugggugaggggcaucacauaaacucuggagcuagacccaguucugcgguuauucauucauuc

SEQ ID NO: 4194222 - RNA, 60 nt, Human
gaggaggcugaacaaugcccuggacauguggacccagcagggugggguuccagccuuuuc

SEQ ID NO: 4194223 - RNA, 61 nt, Human
gaggaggcuguuucucugcauucuaggucaucuccagagaaacugcugguaacguuuccuc

SEQ ID NO: 4194224 - RNA, 61 nt, Human
gaggagggaugugguuguugggugaugcucucagggcacaagaauaaccauauuuaaucuc

SEQ ID NO: 4194225 - RNA, 77 nt, Human
gaggagggcagaggguggcugagagucguugcaauucugaagcuuaugcaaucucucagaaagcccaugucugaguc

SEQ ID NO: 4194226 - RNA, 64 nt, Human
gaggagggcaguuccucuuuuauguuuuaugaccaguuuuucauugagggguauugcuuuucuc

SEQ ID NO: 4194227 - RNA, 82 nt, Human
gaggaggguggaaggccuggaaggaggcugaagaaggagccucauuuucuggaugcuuccaucuaugucuucaucauuccuc

SEQ ID NO: 4194228 - RNA, 58 nt, Human
gaggaggucgcugcugagccccuaccucacucagugaggucagcuggcaggccuccuc

SEQ ID NO: 4194229 - RNA, 60 nt, Human
gaggaggugaauaguuuugagggauauuucauaaaaacccacagaauuauucuuguccuc

SEQ ID NO: 4194230 - RNA, 57 nt, Human
gaggaguaaguauaagauuuggagucagaccacaguucaaguuuugacuuaguccuu

SEQ ID NO: 4194231 - RNA, 96 nt, Human
gaggaguagggaggaucagacucagaaaugacgugggauaggaaaagcaaaacuuucugacgcacauuuucuguguaccugcucccuccacaccuu

SEQ ID NO: 4194232 - RNA, 62 nt, Human
gaggagucgcgcgccggcagccggcccacuccugagggcgcgggcucagcgcucggcuccuc

SEQ ID NO: 4194233 - RNA, 91 nt, Human
gaggagugccagggcacugaccuggacacccgcaacuguaccagugaccucuguguacacagugaguccucucugcccugagguccucuuc

SEQ ID NO: 4194234 - RNA, 64 nt, Human
gaggagugucuauguuuagucuuucuccuugccacagggaaagguuguaacaagacucuucguc

SEQ ID NO: 4194235 - RNA, 72 nt, Human
gaggaguuggucugaggaacaccagcacugccuuacagauaaugugggugacuguuucugagaccaagacuc

SEQ ID NO: 4194236 - RNA, 73 nt, Human
gaggaguuuauccgagggcauaagaaacuggcaacuucauguaaccauggcaaauuauguucuuugaauucuc

SEQ ID NO: 4194237 - RNA, 95 nt, Human
gaggauaaauauauacauggguuugucaacagugguuggcuuuggagaaggacaauucuuccuguuggauaugcuuuuguaaauguuggauccuu

SEQ ID NO: 4194238 - RNA, 70 nt, Human
gaggauaucauuaauuugcuagguuucguucccacagggaaauguuaaaaaccaguacaguugguucuuc

SEQ ID NO: 4194239 - RNA, 81 nt, Human
gaggaugaacauuuuaaggcuuuugauacauguugccaaaacgcucacuagcaaguuuguaucaauuugcuuuaucuccuc

SEQ ID NO: 4194240 - RNA, 85 nt, Human
gaggaugagaguagauaaucuguguaccuucaucggaggacacucccuaccuagacaugaacacagaugucccacucauacccuc

SEQ ID NO: 4194241 - RNA, 66 nt, Human
gcaaggcagcgcggaguagcuagaagcucagaaggaagcugagaauuguuggcucuggcugcaugc

SEQ ID NO: 4194242 - RNA, 67 nt, Human
gcaaggcaguccuggggcccugggcccacucagcgggagccaggacuccccggagagcucaccuugc

SEQ ID NO: 4194243 - RNA, 56 nt, Human
gcaaggcucccgcagcccagggcacucagagccccugggcucagccccagcccugc

SEQ ID NO: 4194244 - RNA, 75 nt, Human
gcaaggggaggcaagaugaagugaggcagggaccacaucuuguaacacccucaggcuucgucuuccaccccuugc

SEQ ID NO: 4194245 - RNA, 83 nt, Human
gcaagggguuccugaggggugauuugggacaggacaucuaaagccagguguacgcucacguccucagucccccaggcuccugc

SEQ ID NO: 4194246 - RNA, 57 nt, Human
gcaaggguccaguaacagaugccagauauucuucaggugauuauacugggcuuuggc

SEQ ID NO: 4194247 - RNA, 61 nt, Human
gcaagggugcaggcugccaccuucugaguuuuauaucaaaacuucucagccugcaccuggc

SEQ ID NO: 4194248 - RNA, 59 nt, Human
gcaagggugggacugggcggggccugaauacccucuggccacaaauagucuccccuggc

SEQ ID NO: 4194249 - RNA, 70 nt, Human
gcaaggucagggcugcagaagaggcaggugggguagcccugccuucucucccagucagcccucaucuagc

SEQ ID NO: 4194250 - RNA, 58 nt, Human
gcaagguggcugcauagucuccagugugaacaaagucuggagauaagcagucccaggc

SEQ ID NO: 4194251 - RNA, 129 nt, Human
gcaaguaagacuguacuuugguuuggaacucuaccaacaguagucacaauuucagaaacacacuucacugacagcaacauuacucuugguauuugaguugccagcacaccugucucuaucuacacuugc

SEQ ID NO: 4194252 - RNA, 103 nt, Human
gcaaguagugguguuuaagaaguauauaagguucagggacuggcuuuccuuaauugauacuaucuuuucuguuaaagucccugccuuaauucccauuacuagc

SEQ ID NO: 4194253 - RNA, 88 nt, Human
gcaagucaagcuucucuccaucugcuuccuccuuagggaaaaucuaaugcuaaaaugacuuucuaaggggaggaagcacagcugcugu

SEQ ID NO: 4194254 - RNA, 58 nt, Human
gcaagucugaaagcaaggaaauguucuccucccccacaccacuuugcagcagacaugu

SEQ ID NO: 4194255 - RNA, 87 nt, Human
gcaagucugcucagaaagugaugaacucugugaccuggagauuaauuuaaaauacaguuuagucauuuauugagcaccacuguaugc

SEQ ID NO: 4194256 - RNA, 59 nt, Human
gaggauguuuucagucuugugcuauuacaaacaauacagcaaugacugaguacauuguc

SEQ ID NO: 4194257 - RNA, 64 nt, Human
gaggcaaaaaguagauuguacccaccugcaacaggugaggcaggcauucuccuuucuguggcuc

SEQ ID NO: 4194258 - RNA, 95 nt, Human
gaggcaacuguggccauuuggagcagcaguuauuccaacaggcuguuaauuaaccuguucaugaaacugcuuuccuaguuucgccauaguuucuc

SEQ ID NO: 4194259 - RNA, 57 nt, Human
gaggcaaggucauguuucuuucuguagugucaagaggagaaucuguuuucuugucuu

SEQ ID NO: 4194260 - RNA, 58 nt, Human
gaggcacaguucuuccuccagauacaauguugguaagaccaggaaucacugugcccuc

SEQ ID NO: 4194261 - RNA, 63 nt, Human
gaggcaccggagaccccagaguccagucugagacggcacagggagcaggucucugguggccuu

SEQ ID NO: 4194262 - RNA, 102 nt, Human
gaggcacuccugcucuguacaagggcuggcuucuucccuggaucuagggguugccccugccuuuuagaagacagaugcacagccccagagccuaguugccuc

SEQ ID NO: 4194263 - RNA, 79 nt, Human
gaggcacugggugggaaggugaacuggucucccaggguagaaaaugaagggacagugugggccaucucacucaggccuc

SEQ ID NO: 4194264 - RNA, 81 nt, Human
gaggcagaaaaaucgcuugaacccaggaaguggagguugcauugcacuccagacugggcaacaagagcgagacuccgucuc

SEQ ID NO: 4194265 - RNA, 100 nt, Human
gaggcagaagaaucacuugaaccccgggaggcggagguugcagugaguggagaucacgccacugcacuccagccugggugacagagugagacuccgucuc

SEQ ID NO: 4194266 - RNA, 65 nt, Human
gaggcagacaaggucccuggucuuugggagcuaccaaugaacuaggaaaggggccugucugcuuc

SEQ ID NO: 4194267 - RNA, 56 nt, Human
gaggcagagaccuucaggaccucacuggaaugugaguucugagggcguucugucuu

SEQ ID NO: 4194268 - RNA, 62 nt, Human
gaggcagagccagucucucacuaaaaaaugcuguuaaaugucagauacuagcucucagccuc

SEQ ID NO: 4194269 - RNA, 73 nt, Human
gaggcagagcuugcagugagccgagauugugccacugcacuccagccugggugacagagcaagacucugccuc

SEQ ID NO: 4194270 - RNA, 99 nt, Human
gaggcagaggaaucacuugaaccugggaggcggggguugcagugagccgagaucgcgccauugcacuccggccugggugacagagugagacucugucuc

SEQ ID NO: 4194271 - RNA, 74 nt, Human
gaggcagagggcucggcggccgcucccgcguccccgcggcgcggcagcccggcacgacccagcacuuuguucuc

SEQ ID NO: 4194272 - RNA, 94 nt, Human
gaggcagauauggcauuuugguaaugugguauacagauuacugaauaauuacauaagcucuggacagccacauuuccuaacaugcaugugccuc

SEQ ID NO: 4194273 - RNA, 59 nt, Human
gaggcagcugaccacaguaugaugcagguccuuugaauauuuucugugauagcugucuc

SEQ ID NO: 4194274 - RNA, 100 nt, Human
gaggcaggaaaaagcgcuugaacccaggaggcggagguugccaugagccgagaucgugccauugcacuccagccuuggcaacaagagugaacucugucuc

SEQ ID NO: 4194275 - RNA, 99 nt, Human
gaggcaggagaaucacuugaaccccggaggcagagguugcagugagccgagaucgagccacugcacuucagccugggcgacagagugagacucugucuu

SEQ ID NO: 4194276 - RNA, 91 nt, Human
gaggcaggagaaucaucugaacccaggagacagguugcagugagccgagaucaugccacugcacuccagccugggcaugagacucugucuc

SEQ ID NO: 4194277 - RNA, 99 nt, Human
gaggcaggagaaucgcuugaacccaggaaguggagguugcaguuagcugagaucgcaccacuauacuccagccugggugacagagcgaaacccugucuc

SEQ ID NO: 4194278 - RNA, 99 nt, Human
gaggcaggagaaucgcuugaaccuggcagguggagguugcagugagccaagauugugccacugcacuucagccugggcaacagagugagacucuaucuc

SEQ ID NO: 4194279 - RNA, 99 nt, Human
gaggcaggagaaucgcuugaaccugggaggcggaggcugcagugagccgagaucgcgccauugcacuccagccuggacaacagagcgagacucugucuc

SEQ ID NO: 4194280 - RNA, 98 nt, Human
gaggcaggagaaucgcuugaacucggcagguggagguuguagugagccgagaucacgccacugcacuccagccugaugaaagaguaagacuccgucuc

SEQ ID NO: 4194281 - RNA, 99 nt, Human
gaggcaggagaauggcgugaacccgagaggcggagcuugcagugagccgagaucgcgccacugcacuccagccugggugacagagcaagacuccaucuc

SEQ ID NO: 4194282 - RNA, 100 nt, Human
gaggcaggagaauugcuugaacccgggaggcggagguugcagugagucgagauugcaccauugcacuccagccuuggcaauaaaagcaaaagucugucuc

SEQ ID NO: 4194283 - RNA, 97 nt, Human
gaggcaggagaauugcuugaacucgggaggaggcugcagggagccaagauugugccacuguacuuccagccugggugacagagcaagacuccgucuc

SEQ ID NO: 4194284 - RNA, 100 nt, Human
gaggcaggagaauugcuugagcucaggaggcagagguugcagugagccgagauugcaccguugcacuccagaguggacaacaagggcaaaacuccgucuc

SEQ ID NO: 4194285 - RNA, 98 nt, Human
gaggcaggagaauuucuugaaccccagaggcggaggcugcagugagccaagaucgugccauugcacuccagucugggaacaaagcgaaacucugccuc

SEQ ID NO: 4194286 - RNA, 97 nt, Human
gaggcaggagacucauuugaacccgggaggcugagguugcagugagccaagauggugccauuguacuccagccugggugacagagcgagacugucuc

SEQ ID NO: 4194287 - RNA, 100 nt, Human
gaggcaggaggaucacuuguacccuggagguggagguugcagugagcggagauugccucacugcacuccagccugggggacaagagggagacuccgucuc

SEQ ID NO: 4194288 - RNA, 99 nt, Human
gaggcaggaggauugcucgagcccaggaguuggaggcugcaguaaggugugauugugccacuguacuccagccugggaaacagagcaagaaccugucuc

SEQ ID NO: 4194289 - RNA, 99 nt, Human
gaggcaggaggauugcuugagcccaaguguuggaagcugcagugaucugugaucacaccacugcauuccagccugggcaacagagcaaaacccugucuc

SEQ ID NO: 4194290 - RNA, 94 nt, Human
gaggcaggauugcgugagcccaggaguuugaugcugcagugagcuaggauggugccacugcacuccagccuggguaacagccagacccugucuc

SEQ ID NO: 4194291 - RNA, 83 nt, Human
gaggcaggcaccuugaaucuguuuucuuaguacuguggggaagagaucugccugggaaagcaagguuguggauuuccagucuc

SEQ ID NO: 4194292 - RNA, 77 nt, Human
gaggcagggcucgggcugggaguccagcaaucugcccuugggcagugucugaagccucagcccgaaaagucucucuc

SEQ ID NO: 4194293 - RNA, 59 nt, Human
gaggcagugagaaauagcaagauuuaggcagaaacuacacguuuuguugcuacuggcuc

SEQ ID NO: 4194294 - RNA, 88 nt, Human
gaggcaguggagagaugguaacccuggggcugcauuacuaaggcagcuuuuaugcacauaagggucacuguuucuugcucucugccuu

SEQ ID NO: 4194295 - RNA, 68 nt, Human
gaggcauaaguagaagagauuguuaagaaggguauucaugugucuuugcucuuucugcuuuaugccuc

SEQ ID NO: 4194296 - RNA, 66 nt, Human
gaggcauagggcagaguccaggaugggcucaauauagagcucuaguugcccucucccuguggcuuc

SEQ ID NO: 4194297 - RNA, 71 nt, Human
gaggcauaugugacuguugaaaguagggguuuugaacucgaccucccuagguccuagucacaguaguccuc

SEQ ID NO: 4194298 - RNA, 65 nt, Human
gaggcaucccuugauguccugcucuagggaggagaagggugaggaguggcugucaagggggccuu

SEQ ID NO: 4194299 - RNA, 70 nt, Human
gaggcaugaacagauucuucauuucugauagacaguacagucuagaggucugauauuuguuguaugaauc

SEQ ID NO: 4194300 - RNA, 64 nt, Human
gaggcaugauuuucucccuggcaacugacuagagucaagauugaaggaggcgaaaauuggucuc

SEQ ID NO: 4194301 - RNA, 57 nt, Human
gaggcauggccugaggcuaggauaaacucccauuuaaacuacuuuauaauaugccuc

SEQ ID NO: 4194302 - RNA, 58 nt, Human
gaggcaugguagauggguagcacugugcuggcacacccuacccucacucccauuccuc

SEQ ID NO: 4194303 - RNA, 93 nt, Human
gaggcauucaggguggcugaauuagguggaggaggaugguggggggcgacagugucguccccuccucucccuaagagucaccagccaugccuc

SEQ ID NO: 4194304 - RNA, 84 nt, Human
gaggccaaagaugcugcucuaggcugcuccgugaauuccaggacuucugagaagcaccuucuggacagcgucuuuacugcccuc

SEQ ID NO: 4194305 - RNA, 111 nt, Human
gaggccaagaccuuguuuaccaccucgcaggacagugcuaggacuagugguugagauuuccuuuugaaguccagggcucucugugggaugguugacaauucuuuuggccuu

SEQ ID NO: 4194306 - RNA, 81 nt, Human
gaggccacacuuacaccaggcugcuccuagccagugacugggcauggcagggguccugguguugacucagugcaauuccuc

SEQ ID NO: 4194307 - RNA, 58 nt, Human
gaggccacagcuaucagggacauagcugaagccagugucuuugaugucuaugugcuuc

SEQ ID NO: 4194308 - RNA, 55 nt, Human
gaggccacuuccuacuggaggagacccuggaagucucccuggaggugguggcauc

SEQ ID NO: 4194309 - RNA, 73 nt, Human
gaggccagacuagagagccaaccgucagggagccgagcagccucuggcuuggcuggcaucucugcccagucuc

SEQ ID NO: 4194310 - RNA, 77 nt, Human
gaggccagccagugucuagucacagguacuuaucuaagccucauaauuauuuggaauaggcauugcauuugugccuc

SEQ ID NO: 4194311 - RNA, 77 nt, Human
gaggccagcgugggaguggggcauagaagguauugccauuucuucaauauauucuuucaccuucuuccugccgccuc

SEQ ID NO: 4194312 - RNA, 103 nt, Human
gauauucauugcuaaauuuacaagauuuggcugaaacuccaaacgucuguccuaucacgguggaguauuagucagucuuuaaaaccuuuagcuuacuguacuc

SEQ ID NO: 4194313 - RNA, 81 nt, Human
gauauugacuuuaaaauggaauaugcaggaauaccuauguuuuaauuguacaaggucauuguugcauguucucucaauguc

SEQ ID NO: 4194314 - RNA, 91 nt, Human
gauauugguguuaaacaguacucgauuuuuguagccuacuucaccuguggaguuuuaugaagaacugagucugucaccucagcacuauuuc

SEQ ID NO: 4194315 - RNA, 62 nt, Human
gauauuuaacucucacagguccucaaugcaguguaaucuacacaccuuugagaagaaauguc

SEQ ID NO: 4194316 - RNA, 127 nt, Human
gauauuuaggcuugguauucacuauucauguuuccuaacuauucacaaggugggacuaucuagcagaguuuguggugugggaaacagagaauagaaaauauuauuuaacacuguagccuauuguauc

SEQ ID NO: 4194317 - RNA, 77 nt, Human
gauauuuuuguauacauuauccuguuucacuuaacacagagcuuagggcuggaacagagagaaugugcaggauuguc

SEQ ID NO: 4194318 - RNA, 77 nt, Human
gaucaaacaaguucucuaggaaguauaaagguuuuuacucuaauucuuuuggcuuaaagagaauguauauuuagauc

SEQ ID NO: 4194319 - RNA, 56 nt, Human
gaucaaauaugagaaaugucagguguggaauaagcccugacagaaaauauuucauc

SEQ ID NO: 4194320 - RNA, 87 nt, Human
gaucaaaugcccagucuggaucuucacaagagagggcgucccuucuggaugccucacuaggacuccagcucacuguggcaucggguc

SEQ ID NO: 4194321 - RNA, 58 nt, Human
gaucaacuuuuagcaugguaccuacgguaaguaaaacagguacuaaugaaaagugauu

SEQ ID NO: 4194322 - RNA, 79 nt, Human
gaucaaggugucaacaagguugcuucuucugaggaccucucugucuucacaugauguuuccucugugcaugccugaguc

SEQ ID NO: 4194323 - RNA, 72 nt, Human
gaucaagucugagguuuguccauccuugguggcaggcuagcuuaaccauggauucacaaaccccauuugauu

SEQ ID NO: 4194324 - RNA, 64 nt, Human
gaucaauucaaacuauuuuccuagauccuaauucuuuggagguaggaggaaagggugagugguc

SEQ ID NO: 4194325 - RNA, 55 nt, Human
gaucacagauuccaugugccggguccaugcugagggcuggcagccugucuguguc

SEQ ID NO: 4194326 - RNA, 60 nt, Human
gaucacaucgaggagcaaucagauggcagccugugaucucucugggauauugaugugauu

SEQ ID NO: 4194327 - RNA, 72 nt, Human
gaucaccuggcuugguggucacagcccugaggaauggaguuucuggagaaucaccaccaggccagaucgauc

SEQ ID NO: 4194328 - RNA, 84 nt, Human
gaucagacauggggagccagaaaagcugccugacuuagguacgagagagucagggcaggcuucuggcaggaagugauauugauc

SEQ ID NO: 4194329 - RNA, 55 nt, Human
gaucagagccugccucaaaagccucagccuugugacuuuuguguagcugcugguu

SEQ ID NO: 4194330 - RNA, 63 nt, Human
gaucagaguggcuagagccuugugacuuuucucuuacuuucugcucuugagcuucucuguguc

SEQ ID NO: 4194331 - RNA, 64 nt, Human
gaucagaugugguucaucaucuuugaauaauauuaaguguuuaauaauguugaauuacuagauc

SEQ ID NO: 4194332 - RNA, 103 nt, Human
gaucagcggugacuagauucucauaggagcgugaaccuuauugugaacuguguaugcgagggaucuagguugcacacuccuuaugagaaucuacugccugauu

SEQ ID NO: 4194333 - RNA, 60 nt, Human
gaucagugcugagagacuaucaauauaggaugaucuguuugaaucuuagcagggcugguu

SEQ ID NO: 4194334 - RNA, 60 nt, Human
gaucaguguaagaauucaaagccuacugguuaaaaccauuagucuauuccuggacugguc

SEQ ID NO: 4194335 - RNA, 98 nt, Human
gaucauaaaucaagacaauauaugauucaaacagcugccugggugugauauaaagcaaacuguggcugccuguugaguaugucccaauuuguaugauc

SEQ ID NO: 4194336 - RNA, 70 nt, Human
gaucauaaaugauauggucacccuuaugaaugacuggugaucuuucauaaggguggccauauaaaagauc

SEQ ID NO: 4194337 - RNA, 55 nt, Human
gaucauccgacauggucucucuggugaugcugacaaggugacguuuuggaugauu

SEQ ID NO: 4194338 - RNA, 61 nt, Human
gaucaucugaaccaaggacagauucauguguccuaauucacacugucugguucauguguuc

SEQ ID NO: 4194339 - RNA, 78 nt, Human
gaucaucuuucaucucuauuauuugacagcauauauuucaucuuauguaguagaaucauauggaugaggguuuuuuuc

SEQ ID NO: 4194340 - RNA, 63 nt, Human
gaucaugcagaguuuauuaccaucuaaacgaauauggcgaguugguagaacuuugcaauuguc

SEQ ID NO: 4194341 - RNA, 86 nt, Human
gaucauuacauuuugucauccugagagauguguuaaauucagacaauuuauuauauccuaggggaauuaugucauaagcugugguc

SEQ ID NO: 4194342 - RNA, 91 nt, Human
gaucauuaucaucauuaagcauuuaugaagcacuuuagaguuauuuacuagaacucaugauaugccuauaagauagauugguauaaugguc

SEQ ID NO: 4194343 - RNA, 130 nt, Human
gaucauuauuacugcagaaaguaauagccuucuguuuuugagucuucaguaaaaggguaagaaaaguaguuuucauuuuaaauauucugcucugauaccaagaacagaaaguaaugcaguuuuaaguguc

SEQ ID NO: 4194344 - RNA, 80 nt, Human
gaucauuucuucacaggguauugggugcaacgcaaguauacaauuugaaaacgucuuugguauucacuugugaagagauc

SEQ ID NO: 4194345 - RNA, 101 nt, Human
gaucauuuucuugccaucaugguacaaaugagaguucuguuuuaugguaacuaaaaaaaguucuuuacuuauuuguuaugauaugggguauuuugaugauu

SEQ ID NO: 4194346 - RNA, 103 nt, Human
gaucauuuuggcucaagagacuggaggagaacuugaggaaggaaccaaaucaauuccuuuuccacaauuuuguuccaaaaaugucucaagauugaaauugauu

SEQ ID NO: 4194347 - RNA, 76 nt, Human
gauccaaagaacauugcugagaccuagauauaccuuucccagaucaauaaauucggguccaguaggucuuuggguu

SEQ ID NO: 4194348 - RNA, 76 nt, Human
gauccaaguccugugcaaaugcaucugacuggcgaacagaaaucccaucaagaacagcugcagggagacugggguc

SEQ ID NO: 4194349 - RNA, 128 nt, Human
gauccaccuuguuaaucugcauacgacauucuuucacaccugcaaggagcuuucauuucacauuugcaaggugaaggugaggcccuugcaggggauggggauggguagagcagugucugagguagguu

SEQ ID NO: 4194350 - RNA, 66 nt, Human
gauccacguguagugacuugguuugggaaaaaagaauccacagggagaggaacagcgcagaggguu

SEQ ID NO: 4194351 - RNA, 55 nt, Human
gauccagauauuugggcugguauacauaaugaugccauguucuugaaucuggguc

SEQ ID NO: 4194352 - RNA, 73 nt, Human
gauccaggggcuggaggcuggggaggaugaggucagcugaugggaaucacacccagcuccaggaccuuggauc

SEQ ID NO: 4194353 - RNA, 72 nt, Human
gauccagguuguucuaugccuccuauaugcucgguacugggucauauacacugcauguaaucagcuuuaauc

SEQ ID NO: 4194354 - RNA, 109 nt, Human
gauccaugauuaacccccucgcuaauuggccaccagccccuugacuuugcugcaggccuucucaggagcugggagcaagaggcugcaaauuggccaagcaggauggguc

SEQ ID NO: 4194355 - RNA, 88 nt, Human
gaucccaucacucaaggaggagaaggauguuuccaguuuucauuucuguagguaaguuauauccuucuccuccuugagugacaugauc

SEQ ID NO: 4194356 - RNA, 82 nt, Human
gaucccuaugacuuggucauuacugaaaaggcaacaaaauugaagacugucuucucauaauuagguaagucagagauggauc

SEQ ID NO: 4194357 - RNA, 56 nt, Human
gaucccuucuuuuucagagaauauagcgugaugagcaaaucugagaaaggagaauc

SEQ ID NO: 4194358 - RNA, 79 nt, Human
gauccuauaagcuaaacauuaugguaggagcugucaguuugaaacagacauggauuucuuacauaaaggggcuuagauu

SEQ ID NO: 4194359 - RNA, 67 nt, Human
gauccuggacggcugcguggaggaggcaguguucaagcagaggucccagggcagcuguccagaaguc

SEQ ID NO: 4194360 - RNA, 78 nt, Human
gauccuguuugauggacuuaaugcacacuuuagcagaggguucuguaugauguguaccuaagucaccggaaacaaauc

SEQ ID NO: 4194361 - RNA, 82 nt, Human
gauccuugugaggacucaggaccacuuguggccuugugugaaggccaucagugguaacugaaugguucuaagcacaauuauc

SEQ ID NO: 4194362 - RNA, 72 nt, Human
gaucgggagagagggaaagggccgagcugcuucaugaccuccagcaggcuccuuccuucucugggccucuuc

SEQ ID NO: 4194363 - RNA, 64 nt, Human
gaucggguggguucugccaucaggaccagggagcccacugaguggccuggagccccgccugguc

SEQ ID NO: 4194364 - RNA, 82 nt, Human
gaucuaagcuuaucuuaaucucuguuggcuuuuuauuuauagaugaagaaacuggaauauagagagcuuaaguguuuagauc

SEQ ID NO: 4194365 - RNA, 59 nt, Human
gaucuauauauucuauguuuugaaaacacuauauguguaacaugauauguguauggauu

SEQ ID NO: 4194366 - RNA, 76 nt, Human
gaucuauuguauagcuuugggacauaaguugcuuuucuuagguaacaucaaacauguuuuaaaguuauucauuguc

SEQ ID NO: 4194367 - RNA, 60 nt, Human
gaucucaagagacuaagaaagggcaauaauaguuguugcaccugccuugcuuuagagauu

SEQ ID NO: 4194368 - RNA, 90 nt, Human
gaucucagaaccuuccaaacauggaacuucaagaagaaagcacuaagaaucagugcuuuucucucuccuuccccuuugaagcuuuggguc

SEQ ID NO: 4194369 - RNA, 82 nt, Human
gaucucuaauacccauuaguguuagggccuguuaccucaaucaugagugacagagcccuaauuauuaagguaauuagaaguu

SEQ ID NO: 4194370 - RNA, 62 nt, Human
gaucucucuagugccaggaaagaacauuuaaagaugugacuaacuugguaccagaucagauc

SEQ ID NO: 4194371 - RNA, 88 nt, Human
gaucucugagauuucuaauaguugagucagcuacuguuggaaugagaaaagcucuaguugucuauaacauguugaauuugucagacuc

SEQ ID NO: 4194372 - RNA, 67 nt, Human
gaucucugcuggcagguuauagagcugcccuuucuccuugggcucucccacaacgugccaguagauc

SEQ ID NO: 4194373 - RNA, 62 nt, Human
gaucucuguggacucuuagcacucaaccuucagauccgagcugcaacgaguuuccagagguu

SEQ ID NO: 4194374 - RNA, 122 nt, Human
gaucugaacaggcagggagaccccaggugacaccuggguuauagguacucuagauaaguaaucugagccaccugagcccauggugggugguucuggccuguuuuccugccagguuucugguc

SEQ ID NO: 4194375 - RNA, 87 nt, Human
gaucugagcaggggaaggauguggcuagaggggcauuuuagacagacaagauccucuguggauuacaccuaggcuaagcaacggguu

SEQ ID NO: 4194376 - RNA, 55 nt, Human
gaucugauuaccuuacuccucaggcagaauccccuggagaggcugggaacagguu

SEQ ID NO: 4194377 - RNA, 75 nt, Human
gaucugauugauauuucuguuuacccuuagcucagguaauuaagaguugacaccaaggaaguaucauuuaguauu

SEQ ID NO: 4194378 - RNA, 63 nt, Human
gaucugccugucucagccucccaugugagccauggcgccaggcuggagggcaauggcaagauc

SEQ ID NO: 4194379 - RNA, 73 nt, Human
gaucugcugcugcugcucagugugaacaagggcugcucccuugucuugcacagaugcagccugcacagcuguc

SEQ ID NO: 4194380 - RNA, 94 nt, Human
gagggcagcaggggaggacagagaucugggccagccccaagagaccccccaggccucucuggcaucuggccaggcuggcuuccuagcagcccuc

SEQ ID NO: 4194381 - RNA, 84 nt, Human
gagggcaggggaggggcucagucuuucuuggcagcagcuuuccucauggcggccaguacguugcucagcuccucccgcuuccuc

SEQ ID NO: 4194382 - RNA, 88 nt, Human
gagggcaguguccccagggggagcaccauggcgcagggaucacagggucuucuugaaaccugcucccucaaaugcuggcaguguccuu

SEQ ID NO: 4194383 - RNA, 64 nt, Human
gagggccagccugccaagggccugagggacaggaacaagaacagcgcucuccgggagagccuuc

SEQ ID NO: 4194384 - RNA, 78 nt, Human
gagggccagguauaguuugaucuucaguuuccucucuggauuugugugacuuuggaauaagcuauauaacuuaccuuc

SEQ ID NO: 4194385 - RNA, 64 nt, Human
gaugaaggaauauugcugagcuagaaacuucuaaggacucucuuagcuuuaauauucccacauu

SEQ ID NO: 4194386 - RNA, 113 nt, Human
gaugaaucaggaaaagagagaacagagauggggccagcugcucccagauccuuagacauucuaaauaagggggagagacucagucuuuucugauuaaucuuugaugauuuauu

SEQ ID NO: 4194387 - RNA, 89 nt, Human
gaugaaugaugggaauauaacagguuguagaauuggagaacguuaaaucuuuguuccuaauggcaaaacauguuuuucucauuuucauc

SEQ ID NO: 4194388 - RNA, 89 nt, Human
gaugacaaagcauugaugaacagucaaaaagugaccauuacucuacuaagagauggccuauaauuugcuuucauuucugcuuugcaauc

SEQ ID NO: 4194389 - RNA, 64 nt, Human
gaugacagcucagaguuucagaaauuuaagacaacagcaggauuagacacuuuggguugucuuc

SEQ ID NO: 4194390 - RNA, 64 nt, Human
gaugacaguucuagcaucugaacccugcccaagacggggcuccucagcauccugagcuguccuc

SEQ ID NO: 4194391 - RNA, 79 nt, Human
gaugacauuuaauuggaugguuuaaguuguaggaccccaaaagaugggcuucacaauggcaaaccauuaaauggucauc

SEQ ID NO: 4194392 - RNA, 77 nt, Human
gaugacccuggugggcacuggcaccugaaugauaauuacaaacucagcaacagagugcucugccacuguggucacuc

SEQ ID NO: 4194393 - RNA, 75 nt, Human
gaugacuaagucuagauucuaguuggaaguuaagaaacugagcuucacuucuggauagagucagcuuucaccauc

SEQ ID NO: 4194394 - RNA, 59 nt, Human
gaugagaaaguggcauucuaaaagaaaggagacuucaucuuucagagugucuuuccauu

SEQ ID NO: 4194395 - RNA, 88 nt, Human
gaugagaaccuucucauucuccaucuggccagagauaaaacaaaacuagcuggcuggaggaggaagugugagggcuuggcuuuucauu

SEQ ID NO: 4194396 - RNA, 76 nt, Human
gaugagaucaugauaccgcagauucauggcaauuucgacaaacagcacagaacucuauauucaugaacaacucauc

SEQ ID NO: 4194397 - RNA, 67 nt, Human
gaugaggcucuuaauuugaaaagaauaugagaauuaaugcuugaguuuaauuggagccugaaucauc

SEQ ID NO: 4194398 - RNA, 97 nt, Human
gaugagggagcugagguucagagaguccuggucauuugcccaauaucauaggacuagcagaugucaggcuguuuuuccuucuggagucucccuuauu

SEQ ID NO: 4194399 - RNA, 77 nt, Human
gaugaggucaucggccgguggugcagaggacugaucuccccuaacaauugaccagcucucuagcccugguccucguu

SEQ ID NO: 4194400 - RNA, 71 nt, Human
gaugaguauuucccacaaaugacagaauguuggacuuaaaagguucuguggcaguuugggaggugacaguu

SEQ ID NO: 4194401 - RNA, 55 nt, Human
gaugagucacucagcagaaaagguguguccaggcgccugccugccucggcucauu

SEQ ID NO: 4194402 - RNA, 69 nt, Human
gaugagucuggagaucaugugggguggauuauuuucuuauuuuugcacuguacauauuucccacuuguc

SEQ ID NO: 4194403 - RNA, 96 nt, Human
gaugaguguccugcugugggccugaugcugccaugagucccugcugcgcacccgcucugccuggccagcccucgggccacacugugacccucuguc

SEQ ID NO: 4194404 - RNA, 88 nt, Human
gaugaguuuauuuuccacugucaggaauucagaguuugaaugauuuuaccacugcucuguucuuggugcagcugggauucuauuuauc

SEQ ID NO: 4194405 - RNA, 57 nt, Human
gaugaucagacuccagcuuaauucucaaaacucagagaagggaaggauucugucauu

SEQ ID NO: 4194406 - RNA, 56 nt, Human
gaugaucucgcuuucugugcuuugaaugaucacguggacacaggaaggggaauauc

SEQ ID NO: 4194407 - RNA, 67 nt, Human
gaugaugaucugagagcuuguuacauaaugcuuucaauccugugaggcaaguacuaucaucauuauc

SEQ ID NO: 4194408 - RNA, 59 nt, Human
gaugaugcuuugucaguauguuuuugguguuucaaguuuauagucacuugagcauuauc

SEQ ID NO: 4194409 - RNA, 55 nt, Human
gaugaugggcauucuuuggcuugcagcuaugucuuucaaagcacugccugucauc

SEQ ID NO: 4194410 - RNA, 66 nt, Human
gaugauguuuaaugcuugaauguuuggaagaagagugcuuugcaaaugucaaggguuaguguuauc

SEQ ID NO: 4194411 - RNA, 63 nt, Human
gaugauguuuacacauagcaggugcucaauaaauauaugugacugauugugaaagucaucauu

SEQ ID NO: 4194412 - RNA, 106 nt, Human
gaugauuaguuuguuuguuuguuuguuuauucauuuuacaauucuucuauguucaguuagugaaagguuguaagauggauaggaacagcaagacucaaugauuauu

SEQ ID NO: 4194413 - RNA, 57 nt, Human
gaugauuuuguuggugauucaaucuguaaaccuugaugaguuauucgcuuagucauu

SEQ ID NO: 4194414 - RNA, 71 nt, Human
gaugcaagugaguucagcauucacucguuuggugcacucaagugcugagagaaugcagaauuuacaguguc

SEQ ID NO: 4194415 - RNA, 72 nt, Human
gaugcacaugugaguauagaaggcaaucuuugucuuuuuuccuuuaaaauuuaacuucuccucauauguauc

SEQ ID NO: 4194416 - RNA, 122 nt, Human
gaugcacucacuaacuauugcagcauaaccaaucacuccacaacuuagcagcuugaaacagcaaacauuuauugucucaguuucuguggguuaggaauuugggcauggcuuuccuguguauc

SEQ ID NO: 4194417 - RNA, 57 nt, Human
gaugcagaaaguagacaccaucuagucacuuuaaggagaaggugucccaacugcguu

SEQ ID NO: 4194418 - RNA, 64 nt, Human
gaugcagagggcugggggaaaaaaucauaaggcuuguggggaucuucuagcuuuucacugcguu

SEQ ID NO: 4194419 - RNA, 77 nt, Human
gaugcagcacaaauaucaacaguguccuucuaagucaauauuugcuaggaaaagcacaggauguucuuguugucauc

SEQ ID NO: 4194420 - RNA, 63 nt, Human
gaugcagcagaggccuugugauacuccccuucagauggaguauuacaaagcaagugcuguguc

SEQ ID NO: 4194421 - RNA, 69 nt, Human
gaugcagcagucccugcaguggggaaaacucaguccaugaacauucacaccagcagggggugcugucuc

SEQ ID NO: 4194422 - RNA, 104 nt, Human
gaugcagccgcuaaacagggaagucucuccucuuccacggacugggcagagccaacgcguccagagccggaagagugacagccuuauuuuugucugugcucauc

SEQ ID NO: 4194423 - RNA, 99 nt, Human
gaugcagcgaugacagagaccacagggcgcucugauuccugguggcuuuguaaccccauaaguccuggcuguguuugguuucuaucauaccucugcauu

SEQ ID NO: 4194424 - RNA, 58 nt, Human
gaugcaggugugccacagagcuucuccaagagugagugcugugcaggugccccugcuc

SEQ ID NO: 4194425 - RNA, 70 nt, Human
gaugcaguggaaagaacccuggacucagaauuaaaaaaccugggugugaguccugucuuugucacuuauc

SEQ ID NO: 4194426 - RNA, 120 nt, Human
gaugcaguuauaucagauaaacccauuuuaagcugaaaauauggugaaguugaagaagcacuucugccuuacgauauuuucaauuuauaauggauggguuuauucagacauaacuccauu

SEQ ID NO: 4194427 - RNA, 55 nt, Human
gaugccagcaggugcaaaugcccuggggcagggcagugcuuggcacagcuggguc

SEQ ID NO: 4194428 - RNA, 77 nt, Human
gaugccaguagaggccaggccucccuggcagagcuaaguagcauggcucagggaggcccugggacccuugccagcuc

SEQ ID NO: 4194429 - RNA, 58 nt, Human
gaugccugaaugaucagucagauucucaucuggaaaucugaaauucaaucagggaguc

SEQ ID NO: 4194430 - RNA, 55 nt, Human
gaugccuuaggucaugacucuuggaaccaguagaccacagagggcucaaggcauc

SEQ ID NO: 4194431 - RNA, 57 nt, Human
gaugccuuuacucuugggucuauugcuauaaagcaaaagagccuggaaaaagacauc

SEQ ID NO: 4194432 - RNA, 73 nt, Human
gaugcgacuguucauggcccgaggccaccaacaaggagaucuggcugccucauggccuugagcugagggcauc

SEQ ID NO: 4194433 - RNA, 70 nt, Human
gaugcuaguuuuuccaugcuaaccagagacauaaagugguuuucuccacuuuugguagaaaagcuacauc

SEQ ID NO: 4194434 - RNA, 58 nt, Human
gaugcucuugauuggaccagggguaggucccgacccaagcugggacaaugaaagcauc

SEQ ID NO: 4194435 - RNA, 56 nt, Human
gaugcucuuugcugccucaguuuuuccaacuggaaaacggaaugaguaagaguauc

SEQ ID NO: 4194436 - RNA, 57 nt, Human
gaugcugacugguguuugccuucugucauauccucaggauuagcaccagaucauauc

SEQ ID NO: 4194437 - RNA, 61 nt, Human
gaugcugcucgggugccugggagcuccuggcugggaggucucugcauguccugagcacauc

SEQ ID NO: 4194438 - RNA, 91 nt, Human
gaugcuggcaggguagcugauggccugcugugcaugcuugcuucugccugcccugcccaggcccaggccagugguucccuucucuagcauc

SEQ ID NO: 4194439 - RNA, 77 nt, Human
gaugcugguuuaaaaugcaaauuccuagauucucucuccaaucuagcugagucagaauuguauuuuaaaccagaauc

SEQ ID NO: 4194440 - RNA, 75 nt, Human
gagguggcuggcugguuuuggugagcuccgaagcugaggaggcugccggggcugccuggggcugccucccgccuc

SEQ ID NO: 4194441 - RNA, 96 nt, Human
gaggugggaauccuggggauggggauggggucacucuggaccugggggucccuccuggcuggcccugcccucuucaucuuuggaaguucccuccuc

SEQ ID NO: 4194442 - RNA, 69 nt, Human
gaggugggaggaucacuuugaguccaggaguuugagaccagucuggaaaacaaagugaguucccauuuc

SEQ ID NO: 4194443 - RNA, 60 nt, Human
gaggugggcugggggcagucaaagagggaggggccucguggugcugcuuccagcucacuc

SEQ ID NO: 4194444 - RNA, 68 nt, Human
gagguggguggaucaccuaaggucaggaguuugagacaagccuggccaacguggugaaaccccaucuc

SEQ ID NO: 4194445 - RNA, 75 nt, Human
gaggugguauuuauaguggugcuuaguguaggcucuggaacuaggcugcuggcuaugaaucccauuaugccacuc

SEQ ID NO: 4194446 - RNA, 74 nt, Human
gagguguccucuuucagagaucucaacgccaacuucgugggaccucucuugagagagcagagcauuaggcccuc

SEQ ID NO: 4194447 - RNA, 97 nt, Human
gagguguuacccacacagcccgcccugaacuuucgggucuccuaaaggaacccacgacgagucaucagggcgacuggaaguggcuggacagcgccuc

SEQ ID NO: 4194448 - RNA, 115 nt, Human
gagguuaaaauacugcuuaaaaagggaaacacucaauuuaguaauucgguugccuagaugaaaucgaguggcuauugauccgugauguuucuagauuuuuaagacuauguacuuc

SEQ ID NO: 4194449 - RNA, 88 nt, Human
gagguuagggggcaagauucugugaaugccuacccugugcugcauccucagcugggcacugucccauaggcucuuuaguccccaccuc

SEQ ID NO: 4194450 - RNA, 82 nt, Human
gagguucagaggaggugaggaugccuuaugacuugugauuuacugggcaauuacuaggccaguuuucacuuuagccaaccuu

SEQ ID NO: 4194451 - RNA, 95 nt, Human
gagguucauggcauguucguugcauguuuucuugucuggagaaguguuggaauaagaaacacuggggcaggaaaguaugcuguacuuugaauuuu

SEQ ID NO: 4194452 - RNA, 73 nt, Human
gagguucuacuggcauuuaguggguagaggacaaggauggcacuaaauauccuacaaugcacaggagagccuc

SEQ ID NO: 4194453 - RNA, 70 nt, Human
gagguucuuagagccaggacugugucucacucaccucugcaucucuagugagugucuggugcagggccuc

SEQ ID NO: 4194454 - RNA, 75 nt, Human
gagguugaaagaagagugccagauggaccucuuggucuuuguggugggaucaggaaauugguacuuuuuucccuc

SEQ ID NO: 4194455 - RNA, 91 nt, Human
gagguuggaauguuuucccuuuuuuacgagaggaaauugagucacaguaagaauaaaugccucucugggagccaggaugacacucgaccuc

SEQ ID NO: 4194456 - RNA, 77 nt, Human
gagguuuacagccagugacuggacaagcuuaucuaggucuucaguguagcugucucccucacauggcugugaagguc

SEQ ID NO: 4194457 - RNA, 56 nt, Human
gagguuucacuguguuguccaggcuggucuugaccucuugggcucaagugauccuc

SEQ ID NO: 4194458 - RNA, 56 nt, Human
gaguaaaauaauccuccucucuuacugaauauuaagagaggaggauuauuuuauuc

SEQ ID NO: 4194459 - RNA, 58 nt, Human
gaguaaaugacaaaauagacuaagaaaacaucaucuaguuauguuauguuguuuacuc

SEQ ID NO: 4194460 - RNA, 90 nt, Human
gauccaggcuuaugacccagagcacugggugugggcgcgagaucgcgcucgccuuuccuagagcuccagggaccguggaggccugagguc

SEQ ID NO: 4194461 - RNA, 76 nt, Human
gauccccuuccaagucuggaaaaugcauguuucauuauuuagaaugauuuaaauguuauuucuaggccugaagauc

SEQ ID NO: 4194462 - RNA, 66 nt, Human
gauccccuugagccagggagcuggcagacacugagggugcugcccugccuaugggucgaggguuuu

SEQ ID NO: 4194463 - RNA, 83 nt, Human
gaucccuggagagcaguggggguggugugaguguuugugcugagcauggaaauuggcauggccuugugcuccuucucaaaguc

SEQ ID NO: 4194464 - RNA, 59 nt, Human
gauccggugccagagugggaucaguucucucagcucuggucccauccuggcuucauguc

SEQ ID NO: 4194465 - RNA, 79 nt, Human
gauccuaacuauguuucaaagucagccaucuggcuaucucaugauaugucaguugcuuuuugaaugcuaguucccaauc

SEQ ID NO: 4194466 - RNA, 81 nt, Human
gauccuauagaccaguuuagguacuaggcucuagguuacaacccuagaagguugguacuaagccaggguuuuguaggcauu

SEQ ID NO: 4194467 - RNA, 58 nt, Human
gauccuccagcugacccaggaccccacaaccccuccagucccaagggcugagaggauc

SEQ ID NO: 4194468 - RNA, 73 nt, Human
gauccugcuggcagggacagacagauauauuuggguuuggaacuaauaacuuguuucuguuuuugcacugauc

SEQ ID NO: 4194469 - RNA, 90 nt, Human
gauccuugaagucuuucuugguauucugagcuaaauauuuuauagaaauugggguagcuaaaaaguaucaggaaaacuagcuucaaaauc

SEQ ID NO: 4194470 - RNA, 80 nt, Human
gauccuugggacagugacuaucugauuuaagggguccauugauaguggacucauauccaugaagguacuucucagggguu

SEQ ID NO: 4194471 - RNA, 92 nt, Human
gaucguguaucucuucucugugucccagcucucagcuugauuaagaggucagaaggaggcuucugcagcaugaggcuggagcacacaugauc

SEQ ID NO: 4194472 - RNA, 112 nt, Human
gaucuaacgccuauucuaaucacucuaccuuagcaggaaauugaauaaggguugugggauccuuagcuuacaagucuucuggugacucugauuaaaauuaagagguuggauu

SEQ ID NO: 4194473 - RNA, 70 nt, Human
gaucuaaugaccggucauacaagcagauacaacggugcugucagggcucagugggauaggucagaugguc

SEQ ID NO: 4194474 - RNA, 74 nt, Human
gaucuaauuuucacucauuugcuaaaaaauugcuagacaaaauucaguaaggcaacuugguugaaauuagaguc

SEQ ID NO: 4194475 - RNA, 62 nt, Human
gaucuagaccugcaguuugaaccuuacuuuugaggcgaggaggcugaacuagggucugguuc

SEQ ID NO: 4194476 - RNA, 61 nt, Human
gaucuaucaugccauugcuuuuucuuaaugauauugggaagaagcaggaguguguagcauc

SEQ ID NO: 4194477 - RNA, 62 nt, Human
gaucuauccaaauguuuacuucuggauauagcauauauuuauccuguaagcuuggguggcuc

SEQ ID NO: 4194478 - RNA, 84 nt, Human
gaucucauccccaguaccuguggcuuguuggauggaagccuuugcuagguuugccaauccacugcagccacagaggaugcuauc

SEQ ID NO: 4194479 - RNA, 96 nt, Human
gaucucccugcuggucaggggauggggcucaggggcccucuccagaaggugacugugccagcuccccuccccagaccucugcagaugaacaggauu

SEQ ID NO: 4194480 - RNA, 74 nt, Human
gaucuccguacgcagggccacugaaagagcaucacguagcaaagcuuuucaggaaauuugugucacaggacguu

SEQ ID NO: 4194481 - RNA, 74 nt, Human
gaucucuaggugaaaaaucaucaugacuugaggauauuauuguuauagaaugguggauuuucugcagagagguu

SEQ ID NO: 4194482 - RNA, 106 nt, Human
gaucucugauugguugugggccaguguggccaggugcugguacuugugcuccagguccuuguacuugcuggccagcugcagcaugucggcugucugguucaggauc

SEQ ID NO: 4194483 - RNA, 62 nt, Human
gaucucuucuucauuuaggaacccugccugcccuaauucugucccugugugggguagagauc

SEQ ID NO: 4194484 - RNA, 57 nt, Human
gaucucuuggucacacaaauguuugauauaauaauuaaauguggagacucaggaguc

SEQ ID NO: 4194485 - RNA, 63 nt, Human
gaucucuuuccauguguguuaaagaacaucucuugugcuaaggagaggcagacacuagagguc

SEQ ID NO: 4194486 - RNA, 108 nt, Human
gaucugaagccagaagacgggccccaggaguaagcccuggauucugaugcagaaguuccuauuuaccuccuuugggacacucacugucuucugagugaauucaguauu

SEQ ID NO: 4194487 - RNA, 105 nt, Human
gaucugggauucagccuggucacugggaguuuuagaagcucuacaggugaugagccuccaaugagcuagguugagacucacuuaccagaaccuggauucuagcuc

SEQ ID NO: 4194488 - RNA, 64 nt, Human
gaucugggcagcacaucaucguauccaccucaugcgguaugaugccaagugcucuacauagauu

SEQ ID NO: 4194489 - RNA, 100 nt, Human
gaucugggguggagaguuuuguagaugucuauuaggucugcuuggugcagagcugaguucaguuucuggauauccuuguuaacuuucugucucauugauc

SEQ ID NO: 4194490 - RNA, 88 nt, Human
gaucuggugucagucccuaaggauaugggcugucccccuaagaugauacauggacacucagaaugucacugagggaccacuggagauc

SEQ ID NO: 4194491 - RNA, 64 nt, Human
gaucugucaucagcaccacaggugcucacucagaacaccuggaagugggugcuauggcaguguc

SEQ ID NO: 4194492 - RNA, 85 nt, Human
gaucuguucccuggcaugauguguucauugaaaacccuguauagaggaguuucacauuagauaugucauuucuuuuuaacagauc

SEQ ID NO: 4194493 - RNA, 67 nt, Human
gaucuuaugguggaugcuggaauagcacaugcagaggaaguauguuauuucaaaauucccuuggauu

SEQ ID NO: 4194494 - RNA, 91 nt, Human
gaucuuccagaaaagaacccagcaugacugauaccuugacuucagccuuaugagauucacagaacuuagucaagcguuccuggauuccauc

SEQ ID NO: 4194495 - RNA, 85 nt, Human
gaucuuuuguuuggucagucuguaaaaacuuuuaaugcuuacaaaaggaauuagaaaauacaugggcuguccuugauaaacaauc

SEQ ID NO: 4194496 - RNA, 81 nt, Human
gaugaaaaguauuuucaaugaguuccacucuguugcuuucauucuucuaauggagugguacuuacuuggcuauucuuuauc

SEQ ID NO: 4194497 - RNA, 87 nt, Human
gaugaaacagucacacaagucauuuucagcaggcuuuaauucucccguagaacuucaguugagaaaggcauggaugccaguuucauc

SEQ ID NO: 4194498 - RNA, 84 nt, Human
gaugaaagcuguggaucccuucagaaaaaugugcaagugcucauaguuuugcauauauuucuaaggagguucaugaauuuuauu

SEQ ID NO: 4194499 - RNA, 73 nt, Human
gaugaaaguugggcuggccagugccaugcagguggaaggacugcuggguggcacugucaccaaugcugucauc

SEQ ID NO: 4194500 - RNA, 69 nt, Human
gaugaaaguuguuagauucuggaaugcuugcauagauguuuuaaccuaugcaguuuaacuaauuuuauc

SEQ ID NO: 4194501 - RNA, 63 nt, Human
gaugaaaugcugagccugaguucucucccagugugggcaauaccugggacucaggguuucauc

SEQ ID NO: 4194502 - RNA, 70 nt, Human
gaugaagacucgggcuagguuauugcccaugggcacacagccagggcuucucccagccaggucuugcauc

SEQ ID NO: 4194503 - RNA, 67 nt, Human
gaugaagagaaugggaugcucuuagauauuuuauggcaaaugaucuaagaauacucauaucuucuuc

SEQ ID NO: 4194504 - RNA, 77 nt, Human
gaugaagauuuuuagaggcauuuuuguuguauauuaugaguaaaauucucuuuggaaaugcuuugagaaucuuaauu

SEQ ID NO: 4194505 - RNA, 68 nt, Human
gaugaagcuuugaagucuaaucuauauuccuuuagccaugguuuuggaauuagacuuuaugcauuauc

SEQ ID NO: 4194506 - RNA, 59 nt, Human
gaugaaggaauacaucaguggcuuugugaaugccaaggcauaugauuguaaccuuuauu

SEQ ID NO: 4194507 - RNA, 56 nt, Human
gaugaaggcugaguggguacggaggcuugacaauagucuucccaccugucuuccuc

SEQ ID NO: 4194508 - RNA, 73 nt, Human
gaugaauaagggauggaggacuguauauaugugcauccaaucuugugccauguuuccauuuucuuguaucauu

SEQ ID NO: 4194509 - RNA, 57 nt, Human
gaugaauaaugacccuaauuaggggaauauccuagucaggauuuuggauuauucguc

SEQ ID NO: 4194510 - RNA, 62 nt, Human
gaugaauccagcaaacagugaggcguagcuugaugaccucagauugcauguucggguucauc

SEQ ID NO: 4194511 - RNA, 102 nt, Human
gaugacugagccagguuuccugucaucagagcguacaccuccaguuagaaagauggacuuguaaacaaaucuaauguaacaugagacuugcuuucggucauc

SEQ ID NO: 4194512 - RNA, 59 nt, Human
gaugacugugugggcuccgaggaccagaacacuggaaucuuggcugugcaugcaucuuc

SEQ ID NO: 4194513 - RNA, 57 nt, Human
gaugagaaggcucagauccaaaggccaacauaguuuucuguuuccugccuucccauu

SEQ ID NO: 4194514 - RNA, 56 nt, Human
gaugaggcagcugcuggagaacgucaaagggugggggcguggcaagcauguucauc

SEQ ID NO: 4194515 - RNA, 60 nt, Human
gaugaggcauaaacacagucacaggccucagccuccaccugggacugucccauccucauc

SEQ ID NO: 4194516 - RNA, 73 nt, Human
gaugaggcucugugggugaguagaaucuuugcuacuuguagauggauuuuguuucucucucacaagaccuuuc

SEQ ID NO: 4194517 - RNA, 86 nt, Human
gaugagggaagauacagggaguaauuuugaacuguagugaguuuugaucaacuaaaauuaucaagauaauuccuuuuucucuuguc

SEQ ID NO: 4194518 - RNA, 59 nt, Human
gaugaggugaaaaguggauggagaggcucagacucaccaacuacaguuguuccuucauu

SEQ ID NO: 4194519 - RNA, 72 nt, Human
gaugagugccugacaguguacacugacagcucacuaaaggguugucauuauuacuauugucauuguuuucuc

SEQ ID NO: 4194520 - RNA, 69 nt, Human
gaugaugacuuuggagcacugccugccucucuuuuugccaagauucaaggagaguguuuccuuaucauu

SEQ ID NO: 4194521 - RNA, 78 nt, Human
gaugaugugggucuuaucacacgguagacauugugaccuucagaaguuuacauaagugaugaugauaccucuaacauu

SEQ ID NO: 4194522 - RNA, 55 nt, Human
gaugauuaaaaucagaugccuaaaaucugacuuuaggcauuagauuuuaaauguc

SEQ ID NO: 4194523 - RNA, 57 nt, Human
gaugauuguugcugcccaaugaugagccaacucuccugccagcauuaaacagucauu

SEQ ID NO: 4194524 - RNA, 66 nt, Human
gaugcaaagaggaccuucaguaacuauuucuaaaauuguuaaauaauuggguucuuuucauguguc

SEQ ID NO: 4194525 - RNA, 80 nt, Human
gagggagggaggagaggagaaagacaacuuuguuucauuuuuuagugaggcagcccacuuuccuuaguuucccuaccuuc

SEQ ID NO: 4194526 - RNA, 65 nt, Human
gagggagucagcaggguccccuugagugguggguaacccuaagauggucuuguuggcuaacccuu

SEQ ID NO: 4194527 - RNA, 57 nt, Human
gagggagugacucaagaguugcacaucccaagagacagcccuuaagagucaucccuc

SEQ ID NO: 4194528 - RNA, 55 nt, Human
gagggagugcuuucugauaguuguuuacuggccucuuaccagaaacugcucccuc

SEQ ID NO: 4194529 - RNA, 92 nt, Human
gagggaguggaacauauaaacuggaaagucaguucugagcaccuuggccucauugcucuugaacuuucuaguuucauguuguugcaucucuu

SEQ ID NO: 4194530 - RNA, 55 nt, Human
gagggaugguaguugacacugaagcaccacacuuuggauuaacugauguucucuc

SEQ ID NO: 4194531 - RNA, 67 nt, Human
gagggauuauuguguccauuugagucaugugguuauaccuacauuuucuaggggaccaagaucuuuu

SEQ ID NO: 4194532 - RNA, 65 nt, Human
gagggauuguagcaagcuuguaaguucaaggauuucuuggcacugccaaccugcuagguucucuc

SEQ ID NO: 4194533 - RNA, 84 nt, Human
gagggcaacaucuuugucacugccacaggcuguguugacaucauccuuggccagcacuuugagcagaugaaggaugaugcuauc

SEQ ID NO: 4194534 - RNA, 65 nt, Human
gagggcacagccuaaagccuaugggagacaggagcuauggaucuauaaguaggggccugacccuc

SEQ ID NO: 4194535 - RNA, 63 nt, Human
gcagcacuuggucaauauccagccucaucucucccaucuugaggagggucugacaaguguagc

SEQ ID NO: 4194536 - RNA, 57 nt, Human
gcagcagaaggccaaggggagcccuagagaaucagcugcccuuugucaccauguugc

SEQ ID NO: 4194537 - RNA, 73 nt, Human
gcagcagaaguccguguccccaggcaguagcaggccuagagcuucacagugccagggggcaggcugucguugc

SEQ ID NO: 4194538 - RNA, 76 nt, Human
gcagcagaauuuuauguuaauggauucgguggaaaauacggcuuuaaugaaacauugacuaugauuacucuguugu

SEQ ID NO: 4194539 - RNA, 91 nt, Human
gcagcagaccuuguuuaauguuucccuggcuuccuucccucuguuuucagucucuggggaggaguggaaaggaaggacaaucucaugcugc

SEQ ID NO: 4194540 - RNA, 65 nt, Human
gcagcagcaggcgcacggccgucuggaucucccuggaggugauggucgagcgcuuguuguaaugc

SEQ ID NO: 4194541 - RNA, 62 nt, Human
gcagcagcaggcgcacggccgucuggaucuccgggacgugaugguggagcgcuuguuguagu

SEQ ID NO: 4194542 - RNA, 76 nt, Human
gcagcagcaguucagcagcaaaucuagaagaggaggggaaaauccugugccgacauauuuuucugucuguugcugc

SEQ ID NO: 4194543 - RNA, 69 nt, Human
gcagcagcuccugccaugagugcugaauuugauguaugauuaaggcagcucacgggcauggggugcugu

SEQ ID NO: 4194544 - RNA, 60 nt, Human
gcagcagcucugaaugggccccugaggcugcacaggggccuuugucacuggggcgcaugc

SEQ ID NO: 4194545 - RNA, 60 nt, Human
gcagcaggagaguuuguccugccaguguucugaggcuggcauggcaccuauuccagcugc

SEQ ID NO: 4194546 - RNA, 60 nt, Human
gcagcaggcuuuucauaccuugagucuuacuuaauguucacaugaaaaagcaacugcugu

SEQ ID NO: 4194547 - RNA, 76 nt, Human
gcagcagucauugucuuuagccagcagucuucuccugggaagggccagcagaaguguggucuagcaguggcgcugc

SEQ ID NO: 4194548 - RNA, 64 nt, Human
gcagcaguuuucccuuuaacuguucauauauaaaacauucucaguugaauauacuugcuguugc

SEQ ID NO: 4194549 - RNA, 83 nt, Human
gcagcaugugguugaagguuauuacuuaugaguuuaaaauaauagcugaugagccgugguuaucuuuaaggcuacuaagcugc

SEQ ID NO: 4194550 - RNA, 72 nt, Human
gcagcauuccuucuggaagcuucaggggagaauuuguuuccuugucuuuuauagcuuccagaggcugccugc

SEQ ID NO: 4194551 - RNA, 59 nt, Human
gcagcauugugagguccugcccagugugguaaugggcaguuagcuugucacaguccugu

SEQ ID NO: 4194552 - RNA, 81 nt, Human
gcagccacaccugguucuagugaaagucuauacaucaccugcagaucuggggcuuugagcuagauauaguaccuggcaugc

SEQ ID NO: 4194553 - RNA, 64 nt, Human
gcagccagagcauccauuuuugucacauaucauauggagagagaaggcuugcugucaggcuugu

SEQ ID NO: 4194554 - RNA, 85 nt, Human
gcagccaugguguuuaguuucugucucucugaggaaggagcuuuacuggcuuaaucagaaacagaaacuaagaacccaugacugu

SEQ ID NO: 4194555 - RNA, 73 nt, Human
gcagcccaagcugaccugcugggcuaguggcccugucccgggagcgcucacaggcaguguugggagagacugc

SEQ ID NO: 4194556 - RNA, 55 nt, Human
gcagcccaggcucgcucacugcaucuuucccuggcagaggggcuagccuggcugc

SEQ ID NO: 4194557 - RNA, 60 nt, Human
gcagcccccauggggaggucaagggucugcccugcccuugggccagcccagggggcaugc

SEQ ID NO: 4194558 - RNA, 62 nt, Human
gcagcccuccucacaucagcguccugggagccuccgcccagggggccggcagaggaggcugu

SEQ ID NO: 4194559 - RNA, 67 nt, Human
gcagccgccggguaugcuguucaggaugguaucacucaccucuugggauuugcaggcucagcgcugc

SEQ ID NO: 4194560 - RNA, 88 nt, Human
gcagccgcuguucauugaggcacuccaggaugcuguugccgaaguucgggaucuccaucugcagugucugggccauggcagcggcugc

SEQ ID NO: 4194561 - RNA, 89 nt, Human
gcagccggaucauaaggaacaaagacagguggugucuggggagucccuguccaggcuuuuucaugcugucucccuccugugaggcuugc

SEQ ID NO: 4194562 - RNA, 91 nt, Human
gcagccucagacuugcaguggguagaggacugaaaccccaagcagccuccucugggcucccugcaacagucugagcccugagagcagcugu

SEQ ID NO: 4194563 - RNA, 57 nt, Human
gcagccucagaggggagauauauucaauaggauuauuuccuugcuuugaggaaaggc

SEQ ID NO: 4194564 - RNA, 71 nt, Human
gcagccuccggcggccggccugagcccgggaugccuccuccucggccuccuccagcugccgcuucagcugc

SEQ ID NO: 4194565 - RNA, 55 nt, Human
gcagccuguguccauacuccuccagccaacaaucugaacaugaggcauaggcugc

SEQ ID NO: 4194566 - RNA, 86 nt, Human
gcagccuucugggccagaucuagggaucuucccucccucccugcacucuagcugcaggagcuuccuggugucugcccagagcuugc

SEQ ID NO: 4194567 - RNA, 84 nt, Human
gcagccuuggagccccaugugcucuuauuacccugucgcacagaagugaugcacagagagaugagacacguggcuuccgguugc

SEQ ID NO: 4194568 - RNA, 114 nt, Human
gcagcgagagggccccgaggaaaccugacccccaccuugcaauuguucccugagguccaggucugagggagcauagagaguggguggcccagggcuccagcugccccucccugc

SEQ ID NO: 4194569 - RNA, 55 nt, Human
gcagcgcuacucacagcucugaaaucgauccagagcauuccacagugagcguugc

SEQ ID NO: 4194570 - RNA, 77 nt, Human
gcagcggacccugagggagcugcuggccuuggagccggguguggccuaccagcacgccuuccucuacauccgccagc

SEQ ID NO: 4194571 - RNA, 74 nt, Human
gcagcggggugggaauagaccugucuaugcaguagaaacaaaccagacauggauccuguucuuacuaacgaugu

SEQ ID NO: 4194572 - RNA, 76 nt, Human
gcagcggugcaggagcggggugcucgguggacucuggaccugcucuuggggcugcuggcccccuucuugcccgugu

SEQ ID NO: 4194573 - RNA, 73 nt, Human
gcagcggugggagguagggggaggaaccgaggcucggucugagaugugcugccucugccaccucccacgaggc

SEQ ID NO: 4194574 - RNA, 70 nt, Human
gcagcuacaagacagccugaaauguacccacccugaccugggugagccacaggaguugucuguuggaugc

SEQ ID NO: 4194575 - RNA, 56 nt, Human
gcagcucacacagcaaguuuuggcaaaaaccaaugucuuacuucucgcugggcugc

SEQ ID NO: 4194576 - RNA, 75 nt, Human
gcagcucacagucuccgccaucccagccuccaaaagggaagagacccagauguggggacucugagagaauucugc

SEQ ID NO: 4194577 - RNA, 92 nt, Human
gcagcucagacugguggguaaaaccuuggaaauuugaaauaagacaacucaggauaguagcccagguauuuaaaccacugugugaccucugc

SEQ ID NO: 4194578 - RNA, 55 nt, Human
gcagcuccaagguauccaccagggucucucugacucagugagggccuugggcugc

SEQ ID NO: 4194579 - RNA, 74 nt, Human
gcagcuccaggcaggugggcugcccuugaggucagccuggguguuuccaggggggcuaccgucucuggagcugu

SEQ ID NO: 4194580 - RNA, 55 nt, Human
gcagcuccuggcacaguuuuuuccagccuaauuggguaaaaugacaggcagcugc

SEQ ID NO: 4194581 - RNA, 69 nt, Human
gcagcugauggaaguccuauuggcagacagccuucucucaucagccccuucaggacuugccucaguugc

SEQ ID NO: 4194582 - RNA, 55 nt, Human
gcagcugcaauaggcaucaagcuaugaaaagcucugaggagcacuauugcagugc

SEQ ID NO: 4194583 - RNA, 67 nt, Human
gcagcugcagguggucccaugcccugugccagacuguguugaggcauggggaggccuggaggcuugc

SEQ ID NO: 4194584 - RNA, 55 nt, Human
gcagcugccuccauggucaaagauggugacaaccaaugggaagcuggcgagcagc

SEQ ID NO: 4194585 - RNA, 85 nt, Human
gcagcugccuugggcuugcuaggaccccugccuggguuuucuggggaccgagaggcccuggucaggucuggcuggaggcagaugc

SEQ ID NO: 4194586 - RNA, 61 nt, Human
gcagcugcgcugguguggggcaugagagcgagguggcuccaggucuccgcggagcagcugc

SEQ ID NO: 4194587 - RNA, 55 nt, Human
gcagcugcuguggcaucaagcucugcgugggcaccaucugacuucacacagcugc

SEQ ID NO: 4194588 - RNA, 61 nt, Human
gaugcaagaacgaauccuacuugcuuacaucaagguguuagcagacuuuuguauuuguauu

SEQ ID NO: 4194589 - RNA, 74 nt, Human
gaugcacggcuucccaaguaaauuuguauuuuggaccagauaaugcuuugcuaugggagacuggccuguacauc

SEQ ID NO: 4194590 - RNA, 82 nt, Human
gaugcagaauuauuuuugcaauauguuccugaauauguaauauaaguguauugggaucauuuugcauccauaguuuuguauc

SEQ ID NO: 4194591 - RNA, 61 nt, Human
gaugcagcacuugccuuacgagcuguucuuucuugcucauugagggcuuugugugcugcuc

SEQ ID NO: 4194592 - RNA, 80 nt, Human
gaugcaggccgguuggaguggacgucauugccgggaacgagcgagucgccgcugcagcccuagugacugcggccugcauc

SEQ ID NO: 4194593 - RNA, 94 nt, Human
gaugcauacuugaaaucuuccaauggucacaucaaucugaaaucacugauuaauucuaaauggugugccauauggagcuuuccuguccuguguc

SEQ ID NO: 4194594 - RNA, 65 nt, Human
gaugccacuuggaagggaaccgaguuugcugauuuaguacguauucuuuucccuuuuuuagcauc

SEQ ID NO: 4194595 - RNA, 75 nt, Human
gaugcccacagucagggcccagauguucacaugcuuggcgguggaggcauaggccugggcccuguucaggucguc

SEQ ID NO: 4194596 - RNA, 79 nt, Human
gaugccuaaggccagaauuauaaaauguuuuauguuguuuuaaaaacauauguauuucucauaauuagguuucggcauc

SEQ ID NO: 4194597 - RNA, 79 nt, Human
gaugccuaugaacucugcaaagcuaugucacacaaagacaucuagcaugacaagcuuuacagaauugaauggaugcauu

SEQ ID NO: 4194598 - RNA, 65 nt, Human
gaugccucuuuuggcugaauuauauccaccauaccaucacucuggugagcaaaaagagaagcauu

SEQ ID NO: 4194599 - RNA, 62 nt, Human
gaugccuggaagacucaauggccugccugaacugcagauaguguccauaaguguuccuauuc

SEQ ID NO: 4194600 - RNA, 69 nt, Human
gaugcgacaagagaggcaagggcugcagucugaguucuaggcuccagcccuggcucuucaccugguguc

SEQ ID NO: 4194601 - RNA, 85 nt, Human
gaugcgcaucagccccgggggcucugugucucgggggcucccaggucggaaucccucucucuaucgggccccagggguuugcauc

SEQ ID NO: 4194602 - RNA, 58 nt, Human
gaugcgcuguggacuggugagguguccaggaccucccucuuucagucccacaguuuuc

SEQ ID NO: 4194603 - RNA, 74 nt, Human
gaugcuagcuuuaagaugagauguggauaacuuuauuccuuccauuauccccacucucuccuggagcuuccauc

SEQ ID NO: 4194604 - RNA, 68 nt, Human
gaugcuauauggggcagccauggcuccaaucaugagguagggacacacuggcugugcccauagagcuc

SEQ ID NO: 4194605 - RNA, 86 nt, Human
gaugcuauuuuugaggugcagcuuaaaggcugccuuguggccccuacauaaucugcugccacucugagcuugcuucaaaauagauc

SEQ ID NO: 4194606 - RNA, 79 nt, Human
gaugcucugcauucugacuuaguuaauaugaccucugaaauuguaaaucacaugaugcuauagucugaauguuuguguc

SEQ ID NO: 4194607 - RNA, 61 nt, Human
gaugcugcugauggcaccuaggcagaagucccaaaggacaccuguugccccuucacagauc

SEQ ID NO: 4194608 - RNA, 64 nt, Human
gaugcuguacuuggcuuuggaaaacacaggggucuggccugugagcugcucaggucagucuguc

SEQ ID NO: 4194609 - RNA, 65 nt, Human
gaugcugugugcuaggauauguuuuuagaguuucaucucuaaaggcaacugaaaguagacagcuc

SEQ ID NO: 4194610 - RNA, 62 nt, Human
gaugcuucccugcucugcacaccucaguaaccaaggcugugacuacgcagggaagauucauc

SEQ ID NO: 4194611 - RNA, 104 nt, Human
gaugcuugagauccauugugcuuuggaacagaauccucuuagcaucccuaccauaagcucagaugaaagaugauuuaaaguacugugguuggcuaacaugcauu

SEQ ID NO: 4194612 - RNA, 76 nt, Human
gcaugaggacggggagcgucggccucucccacucugcgguggagucgggggcgccgccgcucaucucaccuccugc

SEQ ID NO: 4194613 - RNA, 88 nt, Human
gcaugaguaagucaggguugucaguguuucagguggcuugggagucauucuuuccagacacugauugcccagcuugaagcuacucugc

SEQ ID NO: 4194614 - RNA, 75 nt, Human
gcaugaguggcuucaauggguuagugagucagagaagggucuguauggucacugacguggggcuacuugagaugu

SEQ ID NO: 4194615 - RNA, 64 nt, Human
gcaugauagcuaacuccccucacuggaaguacucagaaucccaggggagauggcuguugagugc

SEQ ID NO: 4194616 - RNA, 111 nt, Human
gcaugauauuuauccuuccuuuggggaaucacagaauggaccaguuuuagaaacuuggaaccccauccuagauuuuuccauguguuucuucaugggaggguggaugggugu

SEQ ID NO: 4194617 - RNA, 66 nt, Human
gcaugcagcagcucagaggcaccagggccugccugcagugccaggugcauggcugagucuccaugc

SEQ ID NO: 4194618 - RNA, 60 nt, Human
gcaugcagggagggucuggcuguucucuagccucaccgaggccuuucacugcaucucagc

SEQ ID NO: 4194619 - RNA, 60 nt, Human
gcaugcagugcaauucaauguaguucuuagagagugacauggagcacugugccugcaugu

SEQ ID NO: 4194620 - RNA, 67 nt, Human
gcaugcaucucccagguuacaucugagccuggagucgccaggcuucaaggaccugagggaagcuugu

SEQ ID NO: 4194621 - RNA, 58 nt, Human
gcaugcaugguuugugacuguggguuuguguuuuuguggucuuuguggcugugugugu

SEQ ID NO: 4194622 - RNA, 64 nt, Human
gcaugcgggccugggcuuggcagggucccaucauucuuuuuucugcagccauucagcccuaugc

SEQ ID NO: 4194623 - RNA, 69 nt, Human
gcaugcuaacaaaugucuguaugagaaagagaagaggcuggggcugucucuucucacaucagaagcugc

SEQ ID NO: 4194624 - RNA, 67 nt, Human
gcaugcuguacaacuggcugggcuuucuuauauuucuuguaacuaauuagucucaguguacagaggc

SEQ ID NO: 4194625 - RNA, 56 nt, Human
gcauggaaccugccaguccaggcuccuuucuggauggaacacuggcuuuccacugu

SEQ ID NO: 4194626 - RNA, 79 nt, Human
gcauggaacugagucuggcacgcuuuaaaucuccggggauuuuggcugaugaggaaugcucagcucaauguuuccaugu

SEQ ID NO: 4194627 - RNA, 65 nt, Human
gcauggaauaauuguuucacagaagagggaccuucuucagucagguaauuguuucauuuuauugc

SEQ ID NO: 4194628 - RNA, 69 nt, Human
gcauggagugucuauugggguaaagaaagagcaaggucauucguucuuaacucaaauauauauccaugu

SEQ ID NO: 4194629 - RNA, 75 nt, Human
gcauggauuucuugaauauuuccauuuacuauguagcaaaccccuucagcaccaucguaauguggaaguacaugc

SEQ ID NO: 4194630 - RNA, 59 nt, Human
gcauggcaagacccugucucuacaaaaaagacaaaaguuagcuaggguugguggcgugc

SEQ ID NO: 4194631 - RNA, 74 nt, Human
gcauggcacgggcaggccggcugugcugggggaccuggcgccccccucugcagcugcuggcccaggugcuaagc

SEQ ID NO: 4194632 - RNA, 90 nt, Human
gcauggcaugagauaacugucagcagauuucuggaauucacauaaauggcauccaaaggaagaggcugucagucaucaggucaucugugu

SEQ ID NO: 4194633 - RNA, 79 nt, Human
gcaugggccauaaacggauuuaagaggcugcuagaguauagaauuuaauauaguuagcaucauuaaauaguggcacagc

SEQ ID NO: 4194634 - RNA, 127 nt, Human
gcaugggggucucugcaaagccugucuucugccccuucccugacacauuucucccagucuccaugcugccugggauggagauggaaaugaagggaagccccgcaguagaagaggccaggcucccugu

SEQ ID NO: 4194635 - RNA, 63 nt, Human
gcaugggguccuggcagucuuugguugucugcuaguagauccaugagucaggaccuacauugc

SEQ ID NO: 4194636 - RNA, 71 nt, Human
gcauggggugcagccuuuguuucuacuugguauguuaauuuacauaagcacagauugcugcauccauaugc

SEQ ID NO: 4194637 - RNA, 71 nt, Human
gcaugggucaauggcucuagaggguuguguugggcaaccugcagcuucagccagagggccagggacagugc

SEQ ID NO: 4194638 - RNA, 74 nt, Human
gcauggguucaucuuuggacauguugagguugcagugccugucaacugggaaugucaagagaacgauuguaugu

SEQ ID NO: 4194639 - RNA, 73 nt, Human
gcaugguggugccuaagacacugacuccaauuuuccagugagaacaggaaggcuuuaagcaccaaagccaugc

SEQ ID NO: 4194640 - RNA, 97 nt, Human
gcaugguucugguaaaguuccagaacuggaaaaggacuuucuaaaucaucaggccuaccgucuauucuggaacguaagaccaccuaagaacuauagc

SEQ ID NO: 4194641 - RNA, 65 nt, Human
gcauguacacauagguuacugauuaauaauaauaguguuuauuggguacuuacugugugccaugu

SEQ ID NO: 4194642 - RNA, 81 nt, Human
gcauguacauguuuuauguguguacaugcauauguguauauuauguaugcauguguacauaugguauagauaugugggugu

SEQ ID NO: 4194643 - RNA, 57 nt, Human
gcauguaggggacccagcaagugaguggcagccgcugccaggauccccugccggugc

SEQ ID NO: 4194644 - RNA, 64 nt, Human
gcaugucuaucauuguguuugccagucaccuagcuggugagggauacugauagaaugagcaugc

SEQ ID NO: 4194645 - RNA, 74 nt, Human
gcaugucugcgugcaugucugcgugcaugucagggugcauguccgggugcaugucggggugcaugucaggaugc

SEQ ID NO: 4194646 - RNA, 105 nt, Human
gcaugucugggaggcugcugguggucccuucuggcccuggucauacaugcagacuguggccagguuggaguuggccuuuaggguccccagcuccuugccccaugu

SEQ ID NO: 4194647 - RNA, 88 nt, Human
gcaugugaacauuugggcuaagucuccuucaugauacugucaguaucaugcaauaaggugaggccuacugaguguuuucuaagcgugc

SEQ ID NO: 4194648 - RNA, 86 nt, Human
gcaugugaacugggagggucuugaagaggguacccagccucggggucccggcaccuccuuaacucucccggcucuuuuccacgugu

SEQ ID NO: 4194649 - RNA, 60 nt, Human
gcaugugacucuggcuuacccccuguaauucagagaccugaagccaggguccagacaugu

SEQ ID NO: 4194650 - RNA, 78 nt, Human
gcaugugauauugcacucuucaauggcuuagccccagcuuuuuuccaggccagcugucuaagagaguaaaacaggugc

SEQ ID NO: 4194651 - RNA, 88 nt, Human
gcaugugauauuugaagaaaacuaaauaaaaccucuccuccugccuucgggguaaaauuagguaaucuuuagauacaccacauaaugc

SEQ ID NO: 4194652 - RNA, 72 nt, Human
gcaugugcacuccugggagccaaggaaggcuguucaucguguccuuggaagagcauucccagggugcuuggu

SEQ ID NO: 4194653 - RNA, 94 nt, Human
gcauguguauacaaccugcauguucugcacauguauguaacaaaccugcauguucugcacguguguuuaacaaaccugcauguucugcacaugu

SEQ ID NO: 4194654 - RNA, 55 nt, Human
gcaugugugagaccuuuuagcauuaucaaagauuuuguggagucugcauaugugc

SEQ ID NO: 4194655 - RNA, 68 nt, Human
gcauguguuagagugugcaugcgggccguggggccucacagcaugugugugcacaaucuggcgugugc

SEQ ID NO: 4194656 - RNA, 106 nt, Human
gcauguucaaaacuuucaaaaagacucuggaugauggcuuuuuucccuucaucauccuggaugccaucaaugacagaguuaggcauuuugaccaguuuuggagugc

SEQ ID NO: 4194657 - RNA, 68 nt, Human
gcauguugaagaccuuuagugcuaugugggccuaaacccaguaugacccacuugucuuccacaccagc

SEQ ID NO: 4194658 - RNA, 71 nt, Human
gcauuaaaaacuagucacugcaggaagaccuuaugcagggcauguguaggaauuccagugacuucagaugu

SEQ ID NO: 4194659 - RNA, 68 nt, Human
gcauuaaaaucaucuucaucuuacacagacagaaagugaugucuguaagggaaggugauuugcacugu

SEQ ID NO: 4194660 - RNA, 76 nt, Human
gcauuaacaggcagcaugggccccagcuccuucaagcagagcaaggagagaggagcccacugcuguugaauggugc

SEQ ID NO: 4194661 - RNA, 70 nt, Human
gcauuacaggaaaauaugggcuggguaugagcuggugcucuccagcacagcugcaugaugguccagaugc

SEQ ID NO: 4194662 - RNA, 105 nt, Human
gcauuacucaucuuguuaugaguaccuguuccgauaaaguucaacugaaaauaagagacagaaaaugaacaaaugaaucaguguagcucaaacaagauaaaaugc

SEQ ID NO: 4194663 - RNA, 57 nt, Human
gcauuacuggcccacagagguuuugagccaaucagcucugagacuggguuagaaugu

SEQ ID NO: 4194664 - RNA, 55 nt, Human
gcauuagagcccaucaccuguaaccaagcgaaaggagacauugauggcuuuaagc

SEQ ID NO: 4194665 - RNA, 88 nt, Human
gcauuagauucuuauaggagugcaaacuuuauugugaccuucacaugugagggaucuagguugugcacuccuuauaagaaucuaaugc

SEQ ID NO: 4194666 - RNA, 64 nt, Human
gcauuagccugagagccaagcugugcagcagauggcuuauggcuaaggcuugucaggucuuugc

SEQ ID NO: 4194667 - RNA, 79 nt, Human
gcauuagcugucuucuaguaggccaagaagcuccccaagcaacacaaggagcuuugucccuguuggaaaugcagagugc

SEQ ID NO: 4194668 - RNA, 71 nt, Human
gcauuaguucuuagcagacacagccaccaccgggaauuguuugguccugcuugcugcuuaagaaaaucugc

SEQ ID NO: 4194669 - RNA, 113 nt, Human
gcauuauaccucuauuagguuggugcaaaaguaauugcgguuuucacaauuauacuuuuaauugugaaaaccgcaauuacuuuugcaccaaccuaauauaucuguguuaaugu

SEQ ID NO: 4194670 - RNA, 92 nt, Human
gcauuaucuggaaaaggggaauggguagacuguugaauucaggcaccugaccucauguucacuucguaaaccccucccauuuccaauguugc

SEQ ID NO: 4194671 - RNA, 74 nt, Human
gauuugacacagugacguuuauuugagacgcauuauauaugcagucagagcgaugaauucauucuguuuauauc

SEQ ID NO: 4194672 - RNA, 130 nt, Human
gauuugacuuauagagauccaugaacucugcuugacaacuuuuauuugcuuugucaugaacaggaaucauuuccuggcuacagguaaaauuaucagaaacagaggcucuguggucucuugauggaaauuc

SEQ ID NO: 4194673 - RNA, 65 nt, Human
gauuugagcuacaauaccuccuguuuauugauucacagauagacaaggugauaauagcuucuguc

SEQ ID NO: 4194674 - RNA, 77 nt, Human
gauuugcaaaucagguggucaggcagaugggcuguggguucuaugaacagccaucgccagaucaaugaaaugcuuuc

SEQ ID NO: 4194675 - RNA, 55 nt, Human
gauuugcagggcugccaaaugacugucaucauggcuaaccaaggccugauaaauc

SEQ ID NO: 4194676 - RNA, 77 nt, Human
gauuugcuugaacccaggagguggaggcugcagugauccgagaucacaccacugcacuccagccugggggacagauc

SEQ ID NO: 4194677 - RNA, 97 nt, Human
gauuuggcucucuguuugucuguuauugguguauaagaaugcuugugauucuugcacauugauuuuguauccugagacuuugcugaaguugccuauc

SEQ ID NO: 4194678 - RNA, 116 nt, Human
gauuugggggaagcugauaucugcucaccucuuugggucuuuucuuucucccagcauggggcucucaugagugugugguaaauaaagcaccuaauccuaccucauucccccaauuc

SEQ ID NO: 4194679 - RNA, 100 nt, Human
gauuugggguggagaguucuguagaugucuauuaggucugcuuggugcagagcugaguucaauuccuggauauccuuguuaacuuucugucucauugauc

SEQ ID NO: 4194680 - RNA, 100 nt, Human
gauuugggguggagaguucuguagaugucuauuaggucugcuuggugcagagcugaguucaauuccuggauauccuuguuaacuuucugucucguugauc

SEQ ID NO: 4194681 - RNA, 100 nt, Human
gauuugggguggagaguucuguaggugucuauuagaucugguuggugcagagcugaguucaauuccuggauauccuuguuaacuuucugucucauugauc

SEQ ID NO: 4194682 - RNA, 61 nt, Human
gauuugugaaggagcuuccucuauuugggaaguccccagccagggaaacuuuuucuuaauc

SEQ ID NO: 4194683 - RNA, 70 nt, Human
gauuuuaauauucuuaauugcugagcugaauguuuaucacauuuagcagcaaauaaguagugcuaaaauc

SEQ ID NO: 4194684 - RNA, 116 nt, Human
gauuuuacucagauggaaaggacaauagaaggaaacugacauaaauaggauugaaucccacauuucuaaauauggaacaauuuccauuuuguuuuguuuuucuauaacagaugauc

SEQ ID NO: 4194685 - RNA, 66 nt, Human
gcauuuuaagaugaccugguuucauauuacugucaagcaagagagaacagugucauccuauaaugu

SEQ ID NO: 4194686 - RNA, 94 nt, Human
gcauuuuaaggcuauugucucuucauguguuuaauuuuuacauaaaauaaugauaauaaaaaaugaauaugauggaggauucucuguaaagugc

SEQ ID NO: 4194687 - RNA, 74 nt, Human
gcauuuuguaagucucucuuguuagacuggugaacaaaguggagaggugaggcaagaagagaguuuaaacaugc

SEQ ID NO: 4194688 - RNA, 58 nt, Human
gcauuuuguuuggaaaucuuuauuguuacaaagcaguggcugauuacaaacugagugu

SEQ ID NO: 4194689 - RNA, 81 nt, Human
gcauuuuucagucaucucaaacugugcuuguaaauucagaccuuuuacugaaagcauuaauuuggaugaaaacgaugaugu

SEQ ID NO: 4194690 - RNA, 60 nt, Human
gccaaaaaugucagaaaacauggagugucccagaccuucacccagauuggcauuucaggc

SEQ ID NO: 4194691 - RNA, 85 nt, Human
gccaaaaggaaggauaagacacacacauaugcugaguuagggcgcuuugcucacucaagguugugguguugcaucuucaucuggu

SEQ ID NO: 4194692 - RNA, 60 nt, Human
gccaaaagugugugaaggcaggcacauaaauaguuaagccacagucacacauuuguuggu

SEQ ID NO: 4194693 - RNA, 67 nt, Human
gccaaaauuaagagguuuggcuacaaagccccugcuuuuagccauauagugcucuuguauuuuaggu

SEQ ID NO: 4194694 - RNA, 97 nt, Human
gccaaacaaacuguggaaauugcuauuaccgaugagaaucuccuaagaaaauuaauucucuuggugauuuggguaguuucacauauacaaaacuggc

SEQ ID NO: 4194695 - RNA, 63 nt, Human
gccaaacaccuucaucuagcccugaagguauuuuuauuaggccuaugcagaaggugguuuggc

SEQ ID NO: 4194696 - RNA, 55 nt, Human
gccaaagacugagugguaagugucuuacuguuagacaaaagccucagucuuaggc

SEQ ID NO: 4194697 - RNA, 62 nt, Human
gccaaagccugcuuugccuacaagcagagaaccagaguggucccuccagagcagucuuuggc

SEQ ID NO: 4194698 - RNA, 80 nt, Human
gccaaagcgugacucuuacccggcaacgugugucgccgcuugaucgcagcggugcggugauuggguaggucaguucuggc

SEQ ID NO: 4194699 - RNA, 80 nt, Human
gccaaagcucccagggaccgcagggcaguccccacagagccccgggcugcuccugagcuucccuggaccuagagccuggc

SEQ ID NO: 4194700 - RNA, 74 nt, Human
gccaaagcugggcuuccuaccuuucuucuagaucuuuggaggagcccuggguuagggugggagcaguuuuaggc

SEQ ID NO: 4194701 - RNA, 59 nt, Human
gccaaagguuggccugugaguugcacgccugcagcuggaacuggcagaccaacuauggc

SEQ ID NO: 4194702 - RNA, 69 nt, Human
gccaaaguccacuugcuuucuguaccuggaaaaucauccccaccagcucagacagaugugacugauggc

SEQ ID NO: 4194703 - RNA, 63 nt, Human
gccaaaguccuccagccaugcacacacacgcucugugcuccacugggcaaagggggcauuggc

SEQ ID NO: 4194704 - RNA, 64 nt, Human
gccaaaguugguuagggaucugcugauaucaucucagugccuacuuugaucaauuagucuuggc

SEQ ID NO: 4194705 - RNA, 79 nt, Human
gccaaaucaauucauugacugguucguuaaguacagccauauuguccaacacaacaaucacuuaaugauagaugggggc

SEQ ID NO: 4194706 - RNA, 76 nt, Human
gccaaauccauggguuccugucccgccugccucuuccagaucucagccaggccaggaggcaggggcucaauggggc

SEQ ID NO: 4194707 - RNA, 56 nt, Human
gccaaaugcaggaagagcccuggagcucggaguggagccguugggcuccugcuggc

SEQ ID NO: 4194708 - RNA, 93 nt, Human
gccaaaugcuguacaccugcgggaagguucguuauuaucugaugaaugaaucaaugaaauguagcuuauccauacaaugaaauggcauucggc

SEQ ID NO: 4194709 - RNA, 119 nt, Human
gccaaauguuccuucaggguucccuaggaguucagugugaauugcuugaugaguggacaaagugggagcuauuugaagguaaauuauauugaucaacuagcccccaucagguuuuuggc

SEQ ID NO: 4194710 - RNA, 99 nt, Human
gccaaauuuauguacuucggaauuauuaaaauagaggaugucaugcuaggauugauccauucugcaggcaaaauauucauuuuucaggguuucuuuggc

SEQ ID NO: 4194711 - RNA, 60 nt, Human
gccaaccauuggcuucuugucacagccucgaacugcugggcagguggguggugguugugc

SEQ ID NO: 4194712 - RNA, 72 nt, Human
gccaaccuagagcucacucagccucuccccauuuuuggaaaugauggaaggcuugaguucccaggucaaggc

SEQ ID NO: 4194713 - RNA, 76 nt, Human
gccaaccuccagcuuuuuagagacauuucugguuugauucacggagucuguguugucuagaagagcuugacuuggu

SEQ ID NO: 4194714 - RNA, 73 nt, Human
gccaacguuguaguucugagaaguccaggaaacacuccagccugaggcuaccagauaaauuacagaguugugc

SEQ ID NO: 4194715 - RNA, 80 nt, Human
gccaacugccacuaggccauauagaugagggaaaguguuuauuuauugcucuauuauggccuaaaccggcauuauuuggc

SEQ ID NO: 4194716 - RNA, 63 nt, Human
gccaacuguugcaaaucuuugccagaaggcugcccucaggcagcuggaauuugcucagcuggc

SEQ ID NO: 4194717 - RNA, 102 nt, Human
gccaacuugggagaaaggcaaagagacaagaauuccaacgcuggcuacuugacagcacaaugugacuggagucucuuggcugacuuguauucucucacuggu

SEQ ID NO: 4194718 - RNA, 56 nt, Human
gccaagaauagagauaggugauccccgaaaaacuuuugguaucucugcuucauggu

SEQ ID NO: 4194719 - RNA, 113 nt, Human
gccaagaaugagaugggggcugugggacccgcuucaggcgcauggugagcagaugaugcauccguuucucugucucccguguguccgggucaaggcggccucuggucucuggc

SEQ ID NO: 4194720 - RNA, 78 nt, Human
gccaagacgcucggguaugugcaguccuagaaucccccagcagagccugaggacacaugcacacccugcguccauggc

SEQ ID NO: 4194721 - RNA, 63 nt, Human
gccaagagagaaguaaagcacacugagauaaaucuaguguuucacagcacuuuuucucuaggc

SEQ ID NO: 4194722 - RNA, 95 nt, Human
gccaagcucuucugaguggcacaaaucuagucccuggugaccugcugccaaaaagcauucaaccaaaggaagcuagacccuggccaugaaguggc

SEQ ID NO: 4194723 - RNA, 64 nt, Human
gauaugaacauauccuccggauagcgugagacacguuucagugaucuaaggguauggccauguc

SEQ ID NO: 4194724 - RNA, 64 nt, Human
gauaugaaguggcauugugaagggagauuuuacucuuuucucuuuucugaaggcaacaucuauc

SEQ ID NO: 4194725 - RNA, 77 nt, Human
gauaugaaucagagaagccacuggagguugagaugucucuggaaagacauuuaaugucaacugguuugaagcauguc

SEQ ID NO: 4194726 - RNA, 76 nt, Human
gauaugauucucauuuuauaaacuuauccaacgucacauaggaauaaguggcagaauaagagugagaacucaaauc

SEQ ID NO: 4194727 - RNA, 58 nt, Human
gauaugcuguagucucuacagcugguauugugauaugcuguagucucuacagcugguc

SEQ ID NO: 4194728 - RNA, 97 nt, Human
gauauggaauaaaaucaaucuauagagcuuuagacuauaucaaaagaaauagcucuugaaaucugguugaaguuuuggguugaauucuuuccguguu

SEQ ID NO: 4194729 - RNA, 66 nt, Human
gauauggcccuaucauucauugagugcuuuuagaucucuggcaccccaagaugguggaggcuuauc

SEQ ID NO: 4194730 - RNA, 67 nt, Human
gauauguaccaccucuuaaaaguuagaucgaaauggaauugacagagaggaaggggguggacauuuc

SEQ ID NO: 4194731 - RNA, 130 nt, Human
gauauguccggaauuaugcagcuauuaaaaguguaauacuuuugaacugaaaggcauggcuggaaaaugcaaugcuuuuguuuaaaggcuauauacaaacuuaaugucuucccccaaagucuggaaauac

SEQ ID NO: 4194732 - RNA, 120 nt, Human
gauaugugugugugugugugugugugugcgcgcgcacaucuguguauguguguauucacacuggugugcauacacacauagguaugggcauauauacacaggcacacacacacacauauc

SEQ ID NO: 4194733 - RNA, 110 nt, Human
gauauguuauaguuugucaguggcagaacuaccuuuuuaugaggcaacugucuaaccuacuaagcuucaugaggguuuuuuucugccuuacuuagagauuuagacauuuc

SEQ ID NO: 4194734 - RNA, 75 nt, Human
gauauuaacauuucuggaacugugaauaguuuguacccucugaauaguacauacaguaccagaaaugcuaagauc

SEQ ID NO: 4194735 - RNA, 75 nt, Human
gauauuauaguagaugcuuccuuuguaugcugauuuaauugucaaaacauacuacaagguaugugcuaaaauauc

SEQ ID NO: 4194736 - RNA, 72 nt, Human
gauauucuauuuuagccagcuaauacucaacuacgauuugcaauuuagagaguugugcuuguauagauuguc

SEQ ID NO: 4194737 - RNA, 82 nt, Human
gauauugccacugaagguaggaccaaggcucaccucauugacuaauggguaugguuaaucuuucagccuacaugguaauauc

SEQ ID NO: 4194738 - RNA, 77 nt, Human
gauauuggcuugguuuacaauugguuuucucuaauuuaauagguuaggaagguauaguuguauucugagcuaacauc

SEQ ID NO: 4194739 - RNA, 104 nt, Human
gauauugggaaauugaggcgggaagauagaccgauugaggaaguauagaauuaggggauuaugcugccuuagaaauggcuauaaacuguaauauuuucuauauc

SEQ ID NO: 4194740 - RNA, 88 nt, Human
gauauuguucuguuuuuggaaggagauccacacuuauuuucagcgcuggcagcaguggggucuccuccagcccccggaagcauguguc

SEQ ID NO: 4194741 - RNA, 83 nt, Human
gauauuguugauuucuuuagguguaauaguggcauuuacaacguugagagaaacauacugaaauacuaagaaguuaacugauc

SEQ ID NO: 4194742 - RNA, 68 nt, Human
gauauuuacugucuggcccuugacugaaaaaguuugcugaccucagaaagaacacaggcaguaguguc

SEQ ID NO: 4194743 - RNA, 83 nt, Human
gauauuucaaaguaaagcuauacaucuuuucuuggcccagagaggagcuacaaagaaaguauacuggacguuggaaauguauc

SEQ ID NO: 4194744 - RNA, 67 nt, Human
gauauuucagaugaccaaauggaaaaaagcacuaaagcaauuuucuagcaaauguaucugaaauauu

SEQ ID NO: 4194745 - RNA, 80 nt, Human
gauauuugaggagagguuauccguguuauguucgcuucauucaucaugaauaauacaugguuaaccucuuuuugaauauc

SEQ ID NO: 4194746 - RNA, 78 nt, Human
gaucaaugccagugcucaacuucggcuuguuaccaccaccggggguggaagggagaagguugggugacggcaaugguc

SEQ ID NO: 4194747 - RNA, 61 nt, Human
gaucacacugcucauuagaauuaaguauaaugaaguauuuucaauuuugaggcagugguuc

SEQ ID NO: 4194748 - RNA, 55 nt, Human
gaucacauagacauuagcuccauuuguaauucuuggacuguguggaagugugauu

SEQ ID NO: 4194749 - RNA, 60 nt, Human
gaucacaugaauggaauagaagguugaauaauaacauuucauuucccagucgugcugauc

SEQ ID NO: 4194750 - RNA, 58 nt, Human
gaucaccgagguuccuuucagggcuuaauuucacugcuuugagauuucuuaggugauu

SEQ ID NO: 4194751 - RNA, 60 nt, Human
gaucaccuugggcugacacaacgaucuacuccaccagcuuguucuaucagcucagguguc

SEQ ID NO: 4194752 - RNA, 66 nt, Human
gaucagaaauucagcugacuccacaugguuuuaaggaaaugcaauguaguuaaugagcuuuugauc

SEQ ID NO: 4194753 - RNA, 68 nt, Human
gaucagcaugacagugccauugacgcugaccuucaucucuaggcugcuguugcauuucauguuugauu

SEQ ID NO: 4194754 - RNA, 63 nt, Human
gaucagcugcagaaagguacuaggaaacuuuguaaagugggggaacuguucuguauguugauu

SEQ ID NO: 4194755 - RNA, 59 nt, Human
gaucaggaauauuggaaaguacuuaaaggaugaaguacacuaccaauaguucuuugauu

SEQ ID NO: 4194756 - RNA, 64 nt, Human
gaucaggaguugauuuuggauauauuauaccugauguuuugauaugucccucgacaucaggguc

SEQ ID NO: 4194757 - RNA, 57 nt, Human
gaucaggaugacaacugcuggguucuacuuucccuguucacccaccaucaccugguu

SEQ ID NO: 4194758 - RNA, 82 nt, Human
gaucaggcaaacaaaauggauucucacauaaagaagcauuuuuucucugugguacugagagucuauuuucuucugucucuuc

SEQ ID NO: 4194759 - RNA, 55 nt, Human
gauucuuuacaucucugcugacagauuucaucacuggugcugagugcagggaguc

SEQ ID NO: 4194760 - RNA, 74 nt, Human
gauugaaauauaaucucugguucuuguaugugagauauucccacacugcugaaguuacuagagacuaugcaauc

SEQ ID NO: 4194761 - RNA, 55 nt, Human
gauugacaauuagcccuuaggugagaauguucacuuuggacaagcugggucaguu

SEQ ID NO: 4194762 - RNA, 83 nt, Human
gauugagagcaggagcugugggaagaugguggggccagacaucagggccuuccccugagcuaccccagcuccugugcucacuc

SEQ ID NO: 4194763 - RNA, 81 nt, Human
gauugaggaaauuggaugaaggguacacggggccucugcuguuuuugcaacuuccugugaauccaucauuauuucaaaauc

SEQ ID NO: 4194764 - RNA, 59 nt, Human
gauugaggcuguuaaucauaaaggcccuguagcuagaaugaugagcaauaguuuuaauc

SEQ ID NO: 4194765 - RNA, 86 nt, Human
gauugaguguccagucugcugugguaggaagauccugguagccccagucagaaggugcuuccuaacaaggcagcuguuucucuuuc

SEQ ID NO: 4194766 - RNA, 89 nt, Human
gauugcaauuucacaggcaaaugucaauggguaauuuuugaaguuuuacuuacaaguuuacucuggugacaauuuaugugauuguuauc

SEQ ID NO: 4194767 - RNA, 126 nt, Human
gauugcauaccacugcucucugaccugggugacauagcaagaucgugucucuaaaauaaaauauauauauauuuuugagauguuguuuugcucuugucucccaggcuggaguacaauggugcgauc

SEQ ID NO: 4194768 - RNA, 57 nt, Human
gauugcauuugacaaacaacauugaguuauccaagacuagauguuugcaaagcaauc

SEQ ID NO: 4194769 - RNA, 130 nt, Human
gauugccugauggaguagaggugaggcaaguaaaggaauacagcauugccucuagguuuuggccugagccaaauauagggaugaaguugcuauuuacugagauuugugggaacuggcuuggagggcggac

SEQ ID NO: 4194770 - RNA, 57 nt, Human
gauugcugugcgccccagguguuaugaaaaucacucuccugcaaauguacagcaauu

SEQ ID NO: 4194771 - RNA, 72 nt, Human
gauugcuucaaacugagcuucaaguggcagcugugagugcugcacauaaaagguagcaguuugaaagugauu

SEQ ID NO: 4194772 - RNA, 67 nt, Human
gauugcuuuauuggguuuacugccuuguuugcaaacaagacgguucguaaacuuagugagugccauu

SEQ ID NO: 4194773 - RNA, 63 nt, Human
gauuggaagcauucugaauguccaucaaaggggacugaguuggaaacauucugaauguccauc

SEQ ID NO: 4194774 - RNA, 89 nt, Human
gauuggaauguauguuggcgguaagaaacaaauggaaaguaaggaaaauuuuuucaaguuuuauauugaagcaaacaaaauggcuaauc

SEQ ID NO: 4194775 - RNA, 66 nt, Human
gauuggacagcucguucacucugcacuaaugcacagugauaggcaguugugcucaccuuaccaguc

SEQ ID NO: 4194776 - RNA, 80 nt, Human
gauuggcuaaugcucugugguuuuagggcugauguggagaaucucaacagucagaaugaagcugagcuccgacgccaguu

SEQ ID NO: 4194777 - RNA, 71 nt, Human
gauugggcucucucgugaacaggugguuggggagcccagggccuccagguuugugaguagucgcuccgguc

SEQ ID NO: 4194778 - RNA, 72 nt, Human
gauuggggugguaauacaccguucugccauauuuaaaguauaauaaagcaaaugauguguguugucccauuc

SEQ ID NO: 4194779 - RNA, 90 nt, Human
gauugguguaucauagggccccaguucuuggcugagccagggcucaccuugaguccaguuagugaggcuggguaauggaguauagcaguc

SEQ ID NO: 4194780 - RNA, 73 nt, Human
gauugguuauagcuaggcauuugccuuauuuggauaugguucaauagaaagucccuaguuaauauaacgaauu

SEQ ID NO: 4194781 - RNA, 76 nt, Human
gauugguucaguuaauccuuucaagccaagcccaugaguugugcucugcuuggaacagggguuugcccauccaauc

SEQ ID NO: 4194782 - RNA, 55 nt, Human
gauuguagaggugaaaugucuaugguaggcaacuuccaagauggccucuaagauu

SEQ ID NO: 4194783 - RNA, 74 nt, Human
gauuguauacugcacaaggccuggacacaccauucaaggaaugguguccccugggguuguguaccauuucaguc

SEQ ID NO: 4194784 - RNA, 70 nt, Human
gauugugaacuuucuugagaccagaggcuguaucuuauuuaucuuuggaucuucagaaacuagcacaguc

SEQ ID NO: 4194785 - RNA, 74 nt, Human
gauugugcuuugcaucuuguuccaguaaagucucuugucaguuugcuugucaggagccaagaaaagcagcaauu

SEQ ID NO: 4194786 - RNA, 124 nt, Human
gauuguguaggaagagaguuaaugguagcuuguuggauuuuuaaagucagaucuauuaaugucuauuucacuccgagacucuaugaaucaauaugcugcauuacacugaaucugagauaccauc

SEQ ID NO: 4194787 - RNA, 67 nt, Human
gauuguguuaucagggcagguuucucaaggacguaggguuggagccuuccagguagauggcacaguc

SEQ ID NO: 4194788 - RNA, 74 nt, Human
gauuguucaaauugauuccaaaugaguuccaucgaauggaaauuugaugacaucguaugggcaguuuugaaguc

SEQ ID NO: 4194789 - RNA, 77 nt, Human
gauuuaaaucucacaaguagaaucagccucuugaugggggauuuuuccauuauaaagcuggugcuacgaucugaauu

SEQ ID NO: 4194790 - RNA, 81 nt, Human
gauuuaaguugccuggagcaaaaaucuaaggagcagaguugcagcugguuuuucugaugauuguaauuuagguaaauaguc

SEQ ID NO: 4194791 - RNA, 65 nt, Human
gauuuaauggaggguaaaagacuuuggaauugauuuucucagugcuuaaaacccugcacuagcuc

SEQ ID NO: 4194792 - RNA, 80 nt, Human
gauuuacgugaaaguggauuaaaaggccuuucaaaagaauggguuugaaaaaccucaguccgcuuuaauacacguacauu

SEQ ID NO: 4194793 - RNA, 84 nt, Human
gauuuagucauucuuccuggggguaugaauucacaagggcaagcuuuaaaugcuguuguguacacgccuuuaaaugauugguuc

SEQ ID NO: 4194794 - RNA, 72 nt, Human
gauuuauagugcaaggucuggaugggguccccacuuguuauggguccccccagccagcuuguaguagaaguc

SEQ ID NO: 4194795 - RNA, 102 nt, Human
gauuuauguuaaaguauauuuuuucucaauauuauugguauuuucuuauugaguuuuuuuugcgcauauuauuggaguguaguauacuuuugucauguaauc

SEQ ID NO: 4194796 - RNA, 84 nt, Human
gauuucccgucuuggcccaucguaggugcucaacaauuguuucucaaaugaccagcgccugcagagggacccugacaugaacuc

SEQ ID NO: 4194797 - RNA, 77 nt, Human
gauuuccuaauguggaucucugaacucauuuuacucacaucauugugauuguguaagagguuuaaauuugggaaguc

SEQ ID NO: 4194798 - RNA, 61 nt, Human
gauuucuauuuuaaaggcauauggcuuugugcaaggggcuaugguuuuaaagguggauauc

SEQ ID NO: 4194799 - RNA, 58 nt, Human
gauuucucaaaggaauagagugaugugaaagcucacggucuauucguuggagaguuuc

SEQ ID NO: 4194800 - RNA, 76 nt, Human
gauuucugcucuaauguacaccagcaggcuggaagaacaagccucagcaagcuguggaaauuagagagacuggauc

SEQ ID NO: 4194801 - RNA, 67 nt, Human
gauuucuucugguagcaguggugggagugucaccugauaguuguaauaacaauaccaaaaggaaauc

SEQ ID NO: 4194802 - RNA, 57 nt, Human
gauuucuugagcaaguugcuuaacuuguuuugaguuucccaauuuguaaaagaaguc

SEQ ID NO: 4194803 - RNA, 74 nt, Human
gauuucuuuggguagggagcuggaauccuaaaggcaugccagacuuuccagaacacucucuuacccuagauauc

SEQ ID NO: 4194804 - RNA, 77 nt, Human
gauuugaagcaucagcagagguucaucaggcaggaaagcuuaacucuguucugaagagaaugcugcugaaccagauu

SEQ ID NO: 4194805 - RNA, 61 nt, Human
gauuugauaucuugguauacagauucgauaucucugaaucuguauaccaagaaaucauguu

SEQ ID NO: 4194806 - RNA, 80 nt, Human
gauuugcugcuacguugaauguccauuugagauuugagggcaaggauuuaaagugagaacagucagcacaguuguggguu

SEQ ID NO: 4194807 - RNA, 64 nt, Human
gauuugcuggugaauguauagcugggccuagaagcaaagccuuaaauguucaaccuggcacuuc

SEQ ID NO: 4194808 - RNA, 100 nt, Human
gauuugggguagaaaguucuguagaugucuauuaggucugcuuggugcagagcugaguucaauuccuggauauccuuguuaacuuucugucucguugauc

SEQ ID NO: 4194809 - RNA, 82 nt, Human
gauuuggucaggaugggcagccaaacuagaaauuucaugccagaaauaugaguugguuuggcugacuuagccugauuaaauu

SEQ ID NO: 4194810 - RNA, 61 nt, Human
gauuuggugagugaccuggagaggacugggguggaagucccacagaguggcucaccuaguu

SEQ ID NO: 4194811 - RNA, 82 nt, Human
gauuuguauaggcuuuugccugaagcuaaugguauauuuguuucaauaaacucagugguaacaggcuuaagccuuacuuauu

SEQ ID NO: 4194812 - RNA, 98 nt, Human
gauuuguauguguaugggcagggaggugagggaaagggacugcugugcguuccaugcaucuugauuccauuaucuuuguggcccuaaugcaagcuuuc

SEQ ID NO: 4194813 - RNA, 69 nt, Human
gccagaucuaguguuguaaagcuuuugccauacguuuucuucuaacaguuuuacaguuuuagaucuugu

SEQ ID NO: 4194814 - RNA, 56 nt, Human
gccagcaaggaggggaaaaaugcauaacugcacuuucuucagaagccuugcgaggc

SEQ ID NO: 4194815 - RNA, 86 nt, Human
gccagcaauagacuguuuuuauuguuauggcuuuguaguaugucuuaauagcuauuugggcaauuucaaaauaguuuauuuauggu

SEQ ID NO: 4194816 - RNA, 64 nt, Human
gccagcagcucuugggcgggcagagggcgaggaaagggcgccacugccagggagagcggcuggc

SEQ ID NO: 4194817 - RNA, 57 nt, Human
gccagccagagcguggaauugguagcgccuccuagucccaggauguuuauggcuggu

SEQ ID NO: 4194818 - RNA, 60 nt, Human
gccagccaucugaaggacaaggcgccgaggggugcugcagaccucaugcagguggcuggc

SEQ ID NO: 4194819 - RNA, 85 nt, Human
gccagcccccugcaaccucagcccccuccagauuuugagcaccgacaagcacugggaggaggcugagagcaacuuggcagcuggc

SEQ ID NO: 4194820 - RNA, 55 nt, Human
gccagcccgcugcagaacaccuugcucaucaugcugcuguaaugcagcggguggc

SEQ ID NO: 4194821 - RNA, 83 nt, Human
gccagcccucccuuccucccaggcuucugugcaagcccuuggaccacguaugccaguagccauuggagggcaggaggggcggc

SEQ ID NO: 4194822 - RNA, 103 nt, Human
gccagcccugaugaaaccagcugcucucagcaguuccagggccaucaucaccucucuggcugcuggagcaucugagagcauccugcaaaguuucuggguuggc

SEQ ID NO: 4194823 - RNA, 76 nt, Human
gccagccugcugagaugccucuguccuccaggauaacccuuaucacugcaaggaggcuucucaaggcucuguuagc

SEQ ID NO: 4194824 - RNA, 78 nt, Human
gccagccuggagccuguggccaugaggcuagccugccacugugggccugaagccuggugcuaugagggccagccuggc

SEQ ID NO: 4194825 - RNA, 77 nt, Human
gccagcucaguccuccucucauagagaguucuucauucccuuucccaagcugcucucuggaagggggagcugauggc

SEQ ID NO: 4194826 - RNA, 99 nt, Human
gccagcuccuucugaaugaacaugugcuaaagagaagggcagcugauaaccucuugagcaucuuaauuagcacuggauuucaucagaauggugcugugu

SEQ ID NO: 4194827 - RNA, 60 nt, Human
gccagcucucuucugaaaugugacggaccuaagcaggaagucauccaggacaggaguggc

SEQ ID NO: 4194828 - RNA, 60 nt, Human
gccagcucugcuugcccagucaggccuccuccagccugaccaugggcagcaggcuccggc

SEQ ID NO: 4194829 - RNA, 57 nt, Human
gccagcugaaauuucaguucuguuauuuuauccuuaggugaugggcuuucaguuggc

SEQ ID NO: 4194830 - RNA, 64 nt, Human
gccagcugcuuccaggaauccaucuggccucaacaacauugggcugccuggaauaacggcuggc

SEQ ID NO: 4194831 - RNA, 94 nt, Human
gccagcuggugcagcuccaggaggcucugguugacguucuucuccagguagaaggcgcaguccauggccuggagcccgcucucccagccuuggc

SEQ ID NO: 4194832 - RNA, 74 nt, Human
gccagcuguggguguaggagugaggagaggcacagggcaugcagugccuccuggcccugggccuggaagcuggc

SEQ ID NO: 4194833 - RNA, 130 nt, Human
gcaucagaaacaaaaauuggauuuuagagcuaguuaaugguuuagggcccuggcaaacacuccaugcuuuuaguugggacccucaaacaauuacacugcagaaaauaaaguucccuaaaaagucugaagc

SEQ ID NO: 4194834 - RNA, 128 nt, Human
gcaucagcaucaccugggaacuuauuagagaugcaaauuauugggucccaccccagaucuauugaauuggaaacuggggcagagcccagcaauuuggguuuaacaagccugccaggugauucuaaugc

SEQ ID NO: 4194835 - RNA, 55 nt, Human
gcaucagguagaccaagacucagaucucuacucugcuguuuucuguaccugaagc

SEQ ID NO: 4194836 - RNA, 80 nt, Human
gcaucauauuuucaagguuuauuaaauguugcaugugcagagggggcacuuuacauaaggauaaaccugggagugggugc

SEQ ID NO: 4194837 - RNA, 69 nt, Human
gcaucaugggagugacagggccacuggcaagacuuuuugccagucagccuaguucuucuuuuaagaugc

SEQ ID NO: 4194838 - RNA, 62 nt, Human
gcaucauugagaccagcuucuggguauuuauuugcaguccugauuggcugggguucugaugc

SEQ ID NO: 4194839 - RNA, 65 nt, Human
gcaucauuucucuaauccucauagccucuauuuugcagaugaggaauuugagguuagaaugaugc

SEQ ID NO: 4194840 - RNA, 71 nt, Human
gcauccagcuccaaguuugggcaucagcaauccugccuguuggcugcuaccaauguuggaugcuaggcugc

SEQ ID NO: 4194841 - RNA, 59 nt, Human
gcauccaggacuauaugaugauguucaaaaacugcauauuuuuauguccuuucuggagc

SEQ ID NO: 4194842 - RNA, 75 nt, Human
gcauccaugcaugcagggugugugcucuuuguaucuggcgucuuugggcaauucauccgcauugugugugguugc

SEQ ID NO: 4194843 - RNA, 81 nt, Human
gcaucccugagguguggcugcuuaguuuucgauacuuaccuuguuaccagaugucagacuuuaaaggcuaacagggaaugc

SEQ ID NO: 4194844 - RNA, 55 nt, Human
gcaucccuucucugucgguuuccuggguggggcuuggucacuggaguggggaugc

SEQ ID NO: 4194845 - RNA, 73 nt, Human
gcauccuauugaauguuugauugaaaauucuagaccaggguucuucaguucaggcuguucauuaggauugugc

SEQ ID NO: 4194846 - RNA, 72 nt, Human
gcauccuucucaggggagcuugccuggucaccccucuacucccagaggggugaccagagaagcucuggaugc

SEQ ID NO: 4194847 - RNA, 115 nt, Human
gcauccuuuuuauuuugaauuacauagggguagauauggcaucgucaccuuuucagugcuuggagccacugaacagccugaggagucacccuggcuucagagguggaagggaugu

SEQ ID NO: 4194848 - RNA, 107 nt, Human
gcaucucaggugagucugauguagacaguucgcccaccacauuuugagaaucacugaugccaggggguuuugggugaggagaggcugucuaacucccuuucuguugc

SEQ ID NO: 4194849 - RNA, 55 nt, Human
gcaucucuuuagaaucagauggucuccagagaucauaauggguuaugagaggugc

SEQ ID NO: 4194850 - RNA, 61 nt, Human
gcaucugaaggucuccacacuccacaucccugaagggaugcuguguggccaccuccauggc

SEQ ID NO: 4194851 - RNA, 104 nt, Human
gcaucugacugagaaggccucaguaauucauuaauuucaggguaguaaaucuuuucagcuguguaaauggacugugaauuacaagagucucucagaucagaagc

SEQ ID NO: 4194852 - RNA, 70 nt, Human
gcaucugagcuggccugugacugcacugacaaauagaauacaucagaaauguuuuaugccaguucugugu

SEQ ID NO: 4194853 - RNA, 130 nt, Human
gcaucugaugaaugcugacucugcacgacacuguuuugugugcaagagauucuggcauaaaaggacucagauccuauguucaaacuuuuuacacaccagagcagggaagcagacaacaguccauaagagc

SEQ ID NO: 4194854 - RNA, 66 nt, Human
gcaucugcaauuguuuggaaaacugagcacauuugcuuguuuguucaauccagacaauagcugugu

SEQ ID NO: 4194855 - RNA, 55 nt, Human
gcaucuggcccuugaaaaugcugagcagagaaaugcuagcaguagcgccaggugc

SEQ ID NO: 4194856 - RNA, 80 nt, Human
gcaucuguaaagauaaucauauguuuuuuguccuuuauucuguuaacuauggcauauuacauugauugguuuucagaugu

SEQ ID NO: 4194857 - RNA, 73 nt, Human
gcaucugugugccccacaaacauguaugcaacacccaccaugucuacaagccuuguucggcaccuagagaugc

SEQ ID NO: 4194858 - RNA, 59 nt, Human
gcaucuguguguauuuuaugaagccaaagacuaccacuucauaaguuugucacugaugu

SEQ ID NO: 4194859 - RNA, 68 nt, Human
gcaucuguuagagugugcaugcgggccguggggccucacagcaugugugugcacaaucuggcaugugc

SEQ ID NO: 4194860 - RNA, 81 nt, Human
gcaucuuugaauaacacuaaauguauguaacauauuucugcagccuguguugcguuuugaauagguuagcaacauagaugu

SEQ ID NO: 4194861 - RNA, 82 nt, Human
gcaucuuugcuccuugcuguuagccuacauuauugagaacuuacugaacccuuguaaaugauaguauuuggaggcaaguugc

SEQ ID NO: 4194862 - RNA, 65 nt, Human
gcaucuuugucugaacagggacauucuagacauagccucucaagaggucccugaagauaaauugc

SEQ ID NO: 4194863 - RNA, 83 nt, Human
gcaucuuugugcuaauguaguucuugcuccuaagagcugcacucacggcccaauggggaaggacagcauguaaacaaagaugc

SEQ ID NO: 4194864 - RNA, 55 nt, Human
gcaucuuuuuggguguuauuugcucagaaacuguaaauaaacuacugagagaugu

SEQ ID NO: 4194865 - RNA, 65 nt, Human
gcaugaauauuuuacaccucugcaguaaacucaauuguuaaagcaaggaauagaguaguccaugc

SEQ ID NO: 4194866 - RNA, 55 nt, Human
gcaugaauggaacccccugaguaaugugacugacucaggaagagccaguucaugc

SEQ ID NO: 4194867 - RNA, 70 nt, Human
gccauaggcugggggagcaggaccuggugugccccagagaggugcggccagcccuccaccagcucuaggc

SEQ ID NO: 4194868 - RNA, 63 nt, Human
gccauaugggauaaacccugugccuagaaaugucuggagcagguuuaggagucccuucauggu

SEQ ID NO: 4194869 - RNA, 68 nt, Human
gccauauugguuugggaggcuuugaugagaugauucugucagacagggcuucucaaacuuuaaugggc

SEQ ID NO: 4194870 - RNA, 88 nt, Human
gccaucacauaguaauugauaaauguuaauucacagccaaauaaauuugcuuaaaauuauuugucuggugaguggacaugucgugggc

SEQ ID NO: 4194871 - RNA, 74 nt, Human
gccaucagagacugccaucuccuugcauuccuauuguuccuagggucaggagacacuggcaacacucucuuggu

SEQ ID NO: 4194872 - RNA, 102 nt, Human
gccaucagugacacaggcaggaaaacaaugagccaggugguagcauaaacuuuggaaugagacugcuuuggcacaguguuuacuagcugugugaccuugggc

SEQ ID NO: 4194873 - RNA, 60 nt, Human
gccaucaugccacaguuucccaaagggggcauccacagccuucuauguggcagugauggc

SEQ ID NO: 4194874 - RNA, 72 nt, Human
gccauccucagccagaaagucuguuagggagauagucuuccccuucuuauucuucuuuuucgcugaggcagc

SEQ ID NO: 4194875 - RNA, 56 nt, Human
gccauccugugcugggccggccagcucccagcaauuacaggcccaggacgggaggc

SEQ ID NO: 4194876 - RNA, 96 nt, Human
gccaucuaagacauaucugcuggugcauguggccuugcucuguugcuuuauaccuucagcuuagagaagggaacacaucaucuggagucugauggc

SEQ ID NO: 4194877 - RNA, 59 nt, Human
gccaucuugagccaggaagugaccgaauaaaagguggcucuugggcagauuaauauggu

SEQ ID NO: 4194878 - RNA, 76 nt, Human
gccaugaaaggaagccacuucugggcgcgguauuuaaagauauguuagacagcuucuagaaauggucaccacaggc

SEQ ID NO: 4194879 - RNA, 84 nt, Human
gccaugaccaccuagugucuuuagagucacaaaaccauagccaguuaguguuggaauggaccuuggagauaauuugguucuggc

SEQ ID NO: 4194880 - RNA, 72 nt, Human
gccaugcuguuuccuacaugguguuauuugccaaccugucuggaaccauagcccacuaaggguagcgauggc

SEQ ID NO: 4194881 - RNA, 89 nt, Human
gccauggagaagcaggcucagcccaagguggagaggccauuaaggaggcuggggagccccuccauuucugggcaugauccugccaaggc

SEQ ID NO: 4194882 - RNA, 62 nt, Human
gccauggcagggaccaagcugucauuucucauaaugauuguuuauaaucuugucaaugaggc

SEQ ID NO: 4194883 - RNA, 73 nt, Human
gccauguuuuaugugugugaugggcgccgccaucuucuucgccagggcaaguauggcggccccaaaagauggc

SEQ ID NO: 4194884 - RNA, 103 nt, Human
gccauguuuuuagaaauuagaugggaacuauagggcuuuuauuacaagaaaaauauguaauacuuuuaauuccuucugaguuaaaugucaaaaaauacauggc

SEQ ID NO: 4194885 - RNA, 76 nt, Human
gccauuaaccaaauaguauacaaauaaauguguaauuaaaaaaauauaugugcauuugugugauggagugaguggc

SEQ ID NO: 4194886 - RNA, 76 nt, Human
gccauugggaugucagggcuggcccuggagggcugugcgagcccuagggcugcagccgggcuccuggcucccuggc

SEQ ID NO: 4194887 - RNA, 73 nt, Human
gccauugguuauaaagacucuuaacucccuagcgcuugguuugggcauguugggaagggaagagugagccugc

SEQ ID NO: 4194888 - RNA, 56 nt, Human
gccauugugcagagacacagcagcuccucaccccgcucugcucagcccucaguggc

SEQ ID NO: 4194889 - RNA, 72 nt, Human
gccauuuauugaagauuuugugguugcugauaguugugacauuuuaugacagcaaaccaagagacuucuggu

SEQ ID NO: 4194890 - RNA, 85 nt, Human
gccauuuauugugaggaucaaaugaaauagcaaaaagaaagcaucagucuggugccuagcauuugauucacacucacuaaauggu

SEQ ID NO: 4194891 - RNA, 66 nt, Human
gccauuucguaaugcuaugccuugcuguggaucuauuuucauuacuuaggcaggcauuuagugagu

SEQ ID NO: 4194892 - RNA, 129 nt, Human
gccauuuucucccucgcuuccccccacuucacggccgcgcggcgccccccaacccugguuccguggcgcgcgccucguucacgugacguccccagcguuccgccgcgcgcuaggcgaggggaagggggc

SEQ ID NO: 4194893 - RNA, 59 nt, Human
gcccaaaauggccaaauccaugaggacuugagagaggcacguguguggcuauuuugggu

SEQ ID NO: 4194894 - RNA, 57 nt, Human
gcccaaacuuucucuguuuugucucagcccaaaggugaguugguaggaaguuugagc

SEQ ID NO: 4194895 - RNA, 76 nt, Human
gcccaaaugaaauuugagaaguuugguuuaaacauggaaacauggaaaagcuaauuguacuucucacagauguggc

SEQ ID NO: 4194896 - RNA, 83 nt, Human
gcccaagaccacacagcuagggaguggcagagcuuggaauaacacccaagcuugucugagaucccuaaggcugugcucucagc

SEQ ID NO: 4194897 - RNA, 61 nt, Human
gcccaagagagcgaagguuggcaugcaguuccaacugccuuuccacuuugcuucucugggu

SEQ ID NO: 4194898 - RNA, 77 nt, Human
gcccaagagugcaguuucuaggucacacaaugaacacgugcuuauuaguguuguaagaagcugccacacucucaugc

SEQ ID NO: 4194899 - RNA, 63 nt, Human
gcccaagaucacacuggaaauccugaccaucggcuaguccugaacucagaugugauuuggugc

SEQ ID NO: 4194900 - RNA, 82 nt, Human
gcccaaggaagccuugccugaauacaaaauucugucugaaggaaaucuuggagauaauguguuuacaggagugucugugggu

SEQ ID NO: 4194901 - RNA, 61 nt, Human
gcccaaggcaaagcuagccuggaggaugagcagcauccgggggugguagauuuccuugagc

SEQ ID NO: 4194902 - RNA, 56 nt, Human
gcccaaguacgucaucagaagagcuuagauuggaugcccuuccuugggugcugggu

SEQ ID NO: 4194903 - RNA, 107 nt, Human
gcccaauaaugaacauuuguucuuucauaauagguuguagaaguguuuaagagucugagaguagcuucuaggggcaaugugcaaggacaagugugagaguauugggu

SEQ ID NO: 4194904 - RNA, 67 nt, Human
gcccaauacauucuucauaccuacugagguuggcaacagcuccaagguugaggagugagcccugugc

SEQ ID NO: 4194905 - RNA, 66 nt, Human
gcccaauagugucaugaaaaguacacuauaugagagaucauguggcuaacaaacaagacauuaggc

SEQ ID NO: 4194906 - RNA, 65 nt, Human
gcccaauguuuuucaaauauugcucugucuucccaguauuccuagcagagacaugaaaaacaggc

SEQ ID NO: 4194907 - RNA, 78 nt, Human
gcaagucauucugguccuacaggucacugagaggaguuuggauuuaagacugagugagcuggggagccgguggagggu

SEQ ID NO: 4194908 - RNA, 91 nt, Human
gcaaguccuggugguguuccuagagaugcaauuugauuugaucaaggacuaggucaaaccacagcucuaggcguggccuccagggguuugu

SEQ ID NO: 4194909 - RNA, 77 nt, Human
gcaagugagccagggccaugaggcacagggucacaacuaaaccaguggaccaaggccagcauggcucgggccacagc

SEQ ID NO: 4194910 - RNA, 63 nt, Human
gcaagugcacagaagcagaagcuagaccauucaucugaauuuugugauguuugugguacuugc

SEQ ID NO: 4194911 - RNA, 62 nt, Human
gcaagugguguauugugagucuucaagaaacagcaggagggagguuucacauacuuccuugc

SEQ ID NO: 4194912 - RNA, 77 nt, Human
gcaagugucuuuaaaagugcaaguugugacugauggauacccaggcaguacagaaucuauuccugcaagauacccgc

SEQ ID NO: 4194913 - RNA, 57 nt, Human
gcaaguuacuguugcuuuggcaaagacacagcuucccaggugcaagcaguaaauugc

SEQ ID NO: 4194914 - RNA, 67 nt, Human
gcaaguuauuuccauuuaaagcuaagcacaugacagcuggugacuuuuaauggaaaguaaaauuugc

SEQ ID NO: 4194915 - RNA, 76 nt, Human
gcaaguuucuagguuauggugaugcugcugguccagggaccacaguuugagaaccacuagccuaguuauuccuugu

SEQ ID NO: 4194916 - RNA, 77 nt, Human
gcaauaaauacagauaaggccagcauuucuggaguguuuaauacauugugcuuugcaggcuauaucuuauuugacgc

SEQ ID NO: 4194917 - RNA, 115 nt, Human
gcaauaagccauauucacauuguaauuguucuuuccacauucucuguuuagggauguauucuagcauguuuaaaugaggcugauguagauuaauuucucuguaggaguuuguagc

SEQ ID NO: 4194918 - RNA, 73 nt, Human
gcaauaaugccacauaaggagaaaaaaaucucauugggaccaucauucccugugucuccuuggugggauaugc

SEQ ID NO: 4194919 - RNA, 73 nt, Human
gcaauaauuccaaaauguuaccaauauuuauuacaugauuauguagaaauuaggaugauaguggaauuaaggc

SEQ ID NO: 4194920 - RNA, 68 nt, Human
gcaauaauugcuuuccagaguuagacuucaaaucacugaguagcugacuuauuaaaaguuuuuauugu

SEQ ID NO: 4194921 - RNA, 67 nt, Human
gcaauaauuuaauacagcgcugugguagucuuauuguaaaaccacagggcuuaguggaaauuuuugu

SEQ ID NO: 4194922 - RNA, 67 nt, Human
gcaauacuguaugagcuaugguaggagcacuaaggaagccuuccaaaguuauucaagcaguaagggc

SEQ ID NO: 4194923 - RNA, 66 nt, Human
gcaauacuugguuauauauaaucagggguuuuguaaugaaucuguggaaagguaaccaguaauugc

SEQ ID NO: 4194924 - RNA, 72 nt, Human
gcaauagaucauuagcgggggugagaacugggugaacucggucauuuuucuccuccuucugugauucaaugc

SEQ ID NO: 4194925 - RNA, 57 nt, Human
gcaauaggcagcaagaaauuguuugugcuacacauacaaguucucauguguaucugc

SEQ ID NO: 4194926 - RNA, 77 nt, Human
gcaugacccagggcugcccgcagauaucucugagcuuccacagcugugggcaugagagguccuggggauugucaugc

SEQ ID NO: 4194927 - RNA, 86 nt, Human
gcaugaccucaaaagggaaacaauauucaaguucagcuauauaccaaaaccagaggagaguugaacaguauuugcuucugucaugc

SEQ ID NO: 4194928 - RNA, 79 nt, Human
gcaugacugucuauguccuaaucucagcuaggagaucuugcauuucuuuuccuucuggagauggggaauaggagcaagc

SEQ ID NO: 4194929 - RNA, 87 nt, Human
gcaugagauacaggggaccuagggcugcuggaaggaugggcugcuggggcguaucucuguuccaagccuuaucccugcucuucaugc

SEQ ID NO: 4194930 - RNA, 103 nt, Human
gcaugaggaagcaggcaugguacgacaggcucagccccagcccagauagcauucacaucuuccuggauggggguugaugcccaucacucaccugcucuuuagc

SEQ ID NO: 4194931 - RNA, 78 nt, Human
gcaugagguauagaaacaucgcacagauuguaagggguggccaucccaguugugugauaagucucuugugccacaggu

SEQ ID NO: 4194932 - RNA, 74 nt, Human
gcaugagguggugcuaaucucugcucuugccccaccagugagagcggcucucuguagauagcagcgccuucugu

SEQ ID NO: 4194933 - RNA, 76 nt, Human
gcaugaucucagcaugaacuccagcagacagacaaagagucugcaguaaguuaauagugcugguaaacaucauugc

SEQ ID NO: 4194934 - RNA, 95 nt, Human
gcaugaugaggacacuauacugcucuguuuucauauguuuucaauguuccacgacaaacauguuuagaaagcagcugaagcaucuucuuuuaugc

SEQ ID NO: 4194935 - RNA, 80 nt, Human
gcaugauuugugucuuaacccagagcuggaggagaguauccuucucggguagcuguucccagcucuguguaggagucugc

SEQ ID NO: 4194936 - RNA, 100 nt, Human
gcaugcaaaugaagaggaaugaaacuauguucauuguguacccacuauguggcaagcacugugcuaaacauguaucauaagguaucucauuuuaguaugu

SEQ ID NO: 4194937 - RNA, 97 nt, Human
gcaugcagaaguuggaagaugagggaaggcaucacagaggcuguggggugaacugacuucaaggaauggguccuucccuucagagccacaugugugc

SEQ ID NO: 4194938 - RNA, 55 nt, Human
gcaugcagagucccucugcauuagaacucaagaagugcuuguuaauucugcaugc

SEQ ID NO: 4194939 - RNA, 76 nt, Human
gcaugcagggauaaugccccggagucuaauuagggcuggaaagauguugcccugagauggggauuauuccaacagc

SEQ ID NO: 4194940 - RNA, 63 nt, Human
gcaugcaguaaaauucagcaacaguccgguuagaaauguguugcuggauucauuuuuguaagu

SEQ ID NO: 4194941 - RNA, 55 nt, Human
gcaugcauuuguacuugauuuucuaaauaugugaagguugcaguccaagucaugc

SEQ ID NO: 4194942 - RNA, 58 nt, Human
gcaugcuacaggagccccacuuagaugagacaguuuagggaaagccuccugaggcggc

SEQ ID NO: 4194943 - RNA, 67 nt, Human
gcaugcugagaaacagacguguuggagcuucagggucugcuauaacauuggaugcucagcacacugc

SEQ ID NO: 4194944 - RNA, 58 nt, Human
gcaugcugagcccacgccugggcgugcgcaaucagcccuuggaguugguugaggaugc

SEQ ID NO: 4194945 - RNA, 79 nt, Human
gcaugcuuuauguguggagccagccuggagucagcauccccuguccucuugguuugccuccauggacaaaaacguaggu

SEQ ID NO: 4194946 - RNA, 63 nt, Human
gcaugcuuucacuucucugcagccaguuaguuuagcugguauggcuaacgaggucaaggcggc

SEQ ID NO: 4194947 - RNA, 66 nt, Human
gcauggagacuuagcugugugauuuccauuaccguuaaugggcauuuggcaacuaagucccugugc

SEQ ID NO: 4194948 - RNA, 56 nt, Human
gcauggcagggauuaguaguagcugggaggggacaguuacucaguuccugccaugc

SEQ ID NO: 4194949 - RNA, 63 nt, Human
gcauggccauagccuuauagcaggaccuuucauaacaguccuuuuauccccuaauuggccugc

SEQ ID NO: 4194950 - RNA, 81 nt, Human
gcauggcccagauuugcaggcaacugcugcuaggaauaaucaaaccuuauacuuauucagcacuugcucuguaagucaugc

SEQ ID NO: 4194951 - RNA, 95 nt, Human
gcauggccuguucuguuugcacaagcugagugugggagacaauagggcacugaugauuacaagacagugugguaaauauuauaauagaguugugu

SEQ ID NO: 4194952 - RNA, 70 nt, Human
gcauggcugaacacucagugacuaccacugcacuuuguuguaguuucagcauuagagaugccagcccugu

SEQ ID NO: 4194953 - RNA, 71 nt, Human
gcauggcugggugcaaguauaaccagaggaaacagucugaucuuuucucuggacuauuugcacuccuaugc

SEQ ID NO: 4194954 - RNA, 74 nt, Human
gcaugggaauuuagucuggagugaaaaagccaucaagagguaauuaucaaguucuccaauuaaaaauuguaugc

SEQ ID NO: 4194955 - RNA, 87 nt, Human
gcaugggaccugccaugugauuugaugcugucuuucagaaucacuaucaguggccccugaggagcaucagccaugguagguacaugc

SEQ ID NO: 4194956 - RNA, 56 nt, Human
gcaugggggcuagaacccagggauuugcaguccuaggucagggggugccuccaggu

SEQ ID NO: 4194957 - RNA, 70 nt, Human
gcauguaguuacacaggaaaacauuagcaagauaucuagacuucuauuuggcuccgugugacuuaauugc

SEQ ID NO: 4194958 - RNA, 57 nt, Human
gcauguauacaguagaauacuauucagcaaagaaaggaaugaagggcugauacaugc

SEQ ID NO: 4194959 - RNA, 128 nt, Human
gcauguccauacaguauagguaugucgagaaaugaaguauuauauuuuugugaguugcaauucuuuuauucacauuuuuguguacuuugguugucuuuucuuguguuuuccuaguaccaauguuaugc

SEQ ID NO: 4194960 - RNA, 87 nt, Human
gcaugugaccugccaugugauuugaagcugucuuucagaaucacuaucaguggccccugaggagcgucagccaugguagguacaugc

SEQ ID NO: 4194961 - RNA, 89 nt, Human
gcaugugccauguaguauauaugugugaacauguaugguguguucauaugugugcacauauguauuuuuguguguugugugguaugugc

SEQ ID NO: 4194962 - RNA, 70 nt, Human
gcauguggccuucaggcuggaacugcaaccucagcucuuccugggucucuagccugcuggcccagacugc

SEQ ID NO: 4194963 - RNA, 77 nt, Human
gcaugugggacaguagucacuaaacuagaucaagaagagaaagucuuugcucuuggugaacuacugaaucccauugc

SEQ ID NO: 4194964 - RNA, 57 nt, Human
gcauguggugaccccacucaugguagcagacaccaggugguucaggucaccauaggu

SEQ ID NO: 4194965 - RNA, 90 nt, Human
gcaugugucuccagaucagugagcacucuggaguugcagagggucugcaaauauuccaugcuguucaucauauaaaccuggggacaaugc

SEQ ID NO: 4194966 - RNA, 65 nt, Human
gcaugugucuccccaguggagggugggagcuuagaggucuauggcuacugugagacacaaagugc

SEQ ID NO: 4194967 - RNA, 56 nt, Human
gcaugugugucacuuuccugccugugagcuucuaaagaaggagaacauaugcaugc

SEQ ID NO: 4194968 - RNA, 55 nt, Human
gcauguguuauuucucuguggguccucaugguccaggcagggauugacacauugc

SEQ ID NO: 4194969 - RNA, 80 nt, Human
gcauguuaaauuugagaugcauaugggcuaucuaaguggaaauauuuaauaggcaguuggauaugcaagucuggauaugc

SEQ ID NO: 4194970 - RNA, 63 nt, Human
gcauguuaggaugguuuucuauucucacuggugggaauaugaacuauuccuagcccuaugugc

SEQ ID NO: 4194971 - RNA, 62 nt, Human
gcauguugacugggcuggcucugcuccacgacucacucugggccaguccaccugagacaugu

SEQ ID NO: 4194972 - RNA, 108 nt, Human
gcauguugugaacauguuuaaugguauuuguugaaaaacugugacauauaauugauauuaagacuuucagagagugacaugagaaguagaagccaugauccaacaugc

SEQ ID NO: 4194973 - RNA, 69 nt, Human
gcauguuuacugcucuagguugcacaggcaaugcuuugccaugucaaguuguggcaugucuaaagaugc

SEQ ID NO: 4194974 - RNA, 88 nt, Human
gcauuaaaggcucuugacauacuuaagcucuugacugagggcguguuggagauuaccccuuguuuuugaguacaauaguuuuguuugc

SEQ ID NO: 4194975 - RNA, 129 nt, Human
gcauuaagguaguggccggacuguguauccuuggagguguucaucugcccugaaaagaugggauucugaaccucaaaucgugcuggguagaguggaucuaagauggucaguuauggugcuccugggugc

SEQ ID NO: 4194976 - RNA, 87 nt, Human
gcauuaauaaagacaauuucgagcuguagucaaauuuggagggaauaaacuaccccuuuuccuuauacugaaagucuuuuaauaugc

SEQ ID NO: 4194977 - RNA, 55 nt, Human
gcauuaauguaagacccacuccagucccuucccuggagcuugguccaccuagugc

SEQ ID NO: 4194978 - RNA, 64 nt, Human
gcauuacaugcucuucaaggacucauaucuauuuggugugugugcuugugggcauggucugugu

SEQ ID NO: 4194979 - RNA, 65 nt, Human
gcauuagaacuaagauguccaggguguggaauguaacaggcgccuagggaccugaguucaaaugc

SEQ ID NO: 4194980 - RNA, 80 nt, Human
gcauuagcugggaacuuacuagaaaugcuagcaauaaucagaaucugcauuuuaauaagauucccaaguaauuaugaugc

SEQ ID NO: 4194981 - RNA, 65 nt, Human
gccaguaagugguagagacuuaaaucugguaggcccuuugccauucuucucuacuuacugcuggc

SEQ ID NO: 4194982 - RNA, 61 nt, Human
gccaguagcacaguggacuccaucaugcagaaggcaugaaugaagaacaucugugccaggc

SEQ ID NO: 4194983 - RNA, 76 nt, Human
gccagucacaagcguaccuaauuucggagagugacaaguacucugaaaaagaaagaagguagggcuggugacuggc

SEQ ID NO: 4194984 - RNA, 60 nt, Human
gccagucucugugccagauccugggacaacguggucaccacucugaugaauggagaaggu

SEQ ID NO: 4194985 - RNA, 61 nt, Human
gccagugaaucagcacauccagcagugagaugucacuucuguauguccugcauucaaaggc

SEQ ID NO: 4194986 - RNA, 56 nt, Human
gccaguggcuugccaggcaggacggaagcgcugcccggccauaaaugaccgcuggc

SEQ ID NO: 4194987 - RNA, 88 nt, Human
gccagugggaauuuguugaauuaagauacuuguuuuggugguguuuuuggacguaugccaaauuuguaucuuaaggacaauuacuggc

SEQ ID NO: 4194988 - RNA, 55 nt, Human
gccaguguaagcucuagacuagaaggauccuuuuagaauuagcucuuacauaagc

SEQ ID NO: 4194989 - RNA, 73 nt, Human
gccaguguggugagauuccagguggauaguaugaaaccuaucagcacauacugagaaucacacccauucuugc

SEQ ID NO: 4194990 - RNA, 58 nt, Human
gccagugugucuugcaggcuccccugccucucgcaguggagcagagcuuacagcuggc

SEQ ID NO: 4194991 - RNA, 64 nt, Human
gccaguuagucccauuugugaccuugggaacuuaguguucccagcaagaaaggggguggcuggc

SEQ ID NO: 4194992 - RNA, 121 nt, Human
gccaguuuuuucaggguugcuaaaggcagaauggguucuaguaacuaccagaauggguacugguuuucaugcugaaagaccguauuuaucugcucuuaagccucuaacugaaauggauggc

SEQ ID NO: 4194993 - RNA, 60 nt, Human
gccauacauuuugccugggcuuaaauuuaggcuaccguaagccaggagggugugaugagc

SEQ ID NO: 4194994 - RNA, 62 nt, Human
gccauagccaaagaccuuuucaaccccaagcaucugucucuugguagguacuggcuucaggc

SEQ ID NO: 4194995 - RNA, 62 nt, Human
gccauagggauagaagggguagugauggccacaggauugucucucuuagcuaugcuuauggc

SEQ ID NO: 4194996 - RNA, 61 nt, Human
gccauaggguuagugcaguacccugagcuaauaaaagcacagcuguuaccaaucuuagggc

SEQ ID NO: 4194997 - RNA, 100 nt, Human
gccaucaccagcacagcagcccgcagcagcuucagagcggcuggagagacauuuggggacgagcagccccucuguggcucugccucuguuugccaguggc

SEQ ID NO: 4194998 - RNA, 61 nt, Human
gccaucacgucagcuugccaggugguaaagcaugcccgcuucaccuggcuucugaccuggc

SEQ ID NO: 4194999 - RNA, 64 nt, Human
gccaucagaaucugauaucccaccacaguugaguaucucuggucugauaccggauuccaguugc

SEQ ID NO: 4195000 - RNA, 77 nt, Human
gccauccacauaugugucccugcuacucaacagggauccuguugauuggcauggauacagcaagcagaggugaaggc

SEQ ID NO: 4195001 - RNA, 80 nt, Human
gccauccuggccuccaggccuccuggcagccucucugccugcaggguccaggcuguguggucaugguggcuggagagggc

SEQ ID NO: 4195002 - RNA, 78 nt, Human
gccaucuacgcgucugcccaucuccgggcggggcgccggccuuggcucgcgcgcggcagggggcgggcgcgagguggc

SEQ ID NO: 4195003 - RNA, 108 nt, Human
gccaucuagauuggcaaucaggggacagcccgugucaucagcugcugacucccagggcagcucagcaacggggcugagagcccuugacucccacuucuguugauaggc

SEQ ID NO: 4195004 - RNA, 64 nt, Human
gccaucuggagagugaaauacuagucuaccauaugccuauauaacaccauguucuacagauggc

SEQ ID NO: 4195005 - RNA, 59 nt, Human
gccaucuggcauugcagcaccugauccauuugggaaggguauucagcguugucgauggc

SEQ ID NO: 4195006 - RNA, 91 nt, Human
gccaugacaccucugaaacucuccccuggucuuaccucacagugaccugcaaggaaagucacuagaaccagaggaggcagguuuggauggc

SEQ ID NO: 4195007 - RNA, 60 nt, Human
gccaugaggaacuguaagacaauuaaaccucuuuugucuauaaauuaugcagucucaggc

SEQ ID NO: 4195008 - RNA, 57 nt, Human
gccaugaggccucugaggccuaggcucagauugaaucauggccuuugaggccuaggc

SEQ ID NO: 4195009 - RNA, 61 nt, Human
gccaugcagccccugaaaauggcagcaccacuagguagcagccauggugaggguugcaggc

SEQ ID NO: 4195010 - RNA, 60 nt, Human
gcccugucccuuggcuucuaggcucucaaccuguuuagaaggcaagcuugguacaggagu

SEQ ID NO: 4195011 - RNA, 83 nt, Human
gcccugucuccaccugcaucacaggcaagcaaggcuuucugcugggaacagcuugggugugccugcgagcuguggagugaggc

SEQ ID NO: 4195012 - RNA, 110 nt, Human
gcccugucuucuaagccucuaccuuuuuucugucuuuagaaaaagagaagcucuuuaaccuucugcucucagguuucaagacaggaaaacugggggcuggucaucagugc

SEQ ID NO: 4195013 - RNA, 72 nt, Human
gcccuuaacacccacucacaucacagagcccccaugaggucuuccugugaagaucugggugcugaaauuggc

SEQ ID NO: 4195014 - RNA, 63 nt, Human
gcccuuacugagcucagcaucaucugauaguggcuucaaacaaugccaagucuuaaugagggc

SEQ ID NO: 4195015 - RNA, 65 nt, Human
gcccuuagaaauguaccaaaggaagcaucuugaaugcauuuuccuuugacauuuaugagauuugc

SEQ ID NO: 4195016 - RNA, 56 nt, Human
gcccuucaguuacuccuugaugucagaguccccauucccugggagugaaggagggu

SEQ ID NO: 4195017 - RNA, 69 nt, Human
gcccuuccuggcagaggccccgacagcacuggucccacacagcccccugccuggggcccugucaagcgc

SEQ ID NO: 4195018 - RNA, 68 nt, Human
gcccuucugcucuucuguucggugacacacaguguuccuccccugaagaggacgcagcagcaaggugc

SEQ ID NO: 4195019 - RNA, 78 nt, Human
gcccuugaaauaaugagcugugaucuaugauaaaugugccaauaacacauuuuccagggcagcauauuucagaugggu

SEQ ID NO: 4195020 - RNA, 64 nt, Human
gcccuugauuauuucuccuccccuguuagcaaaaaauuaaagggacaggaaagacgaagagggc

SEQ ID NO: 4195021 - RNA, 60 nt, Human
gcccuugcugcugcaucugagcaugugugcuugccaaagcuuggagaagcagcugguggc

SEQ ID NO: 4195022 - RNA, 83 nt, Human
gcccuuggccacguagaagugccgcgagaugaagcugacaauggcguccgugcagcgguaguucucguggaagaccaggcggc

SEQ ID NO: 4195023 - RNA, 92 nt, Human
gcccuuggcuucucucuaagguugugggacaccccugagccaauuauuagguccaggaguaucuaauaaucugagaacuagucacugagggc

SEQ ID NO: 4195024 - RNA, 71 nt, Human
gcccuuguggcaggcugaguuggccuggugagucaccuuaucuugugccaagucacuugaaucugcagggc

SEQ ID NO: 4195025 - RNA, 111 nt, Human
gcccuuucaugaccaaccacauuggggcuaggccauuucuccuggcggggcccaugugccuccccagguucaggaggugggugcuggcucucugugucuguuccugauugc

SEQ ID NO: 4195026 - RNA, 84 nt, Human
gcccuuuugguauuucaaacaaaagcaauuuaauugaggaaauuaguuacaugguuguuggaaaugcugggaaaacaaaagggu

SEQ ID NO: 4195027 - RNA, 69 nt, Human
gccgaauuggugagggauugucuaucaaauggcacuuucugggugguggagaccucgcuaacccccggc

SEQ ID NO: 4195028 - RNA, 107 nt, Human
gccgagaacgugugacucccugggccaguuucucauugaaaucagaugacgcaggaaguaucauccacauuucagugauaggcugcccccuagugacaauuuucagc

SEQ ID NO: 4195029 - RNA, 73 nt, Human
gccgagcgggagauuuaugguggcguuugcuuucauuauguguggaggcugccucgugagcucgcugcguggc

SEQ ID NO: 4195030 - RNA, 56 nt, Human
gccgaggcucugcccagcugcuguuaaaaauccuaggagcugugcagacacuucgc

SEQ ID NO: 4195031 - RNA, 87 nt, Human
gccgagggcuuggagcccuagaugaggccccagccagccggagggcuuccugggggcagcagucuugaagggcuuguaggacuuggc

SEQ ID NO: 4195032 - RNA, 123 nt, Human
gccgcacggugggaguuuaaaaguguugcuccaucuuggucuucaguaagacugugaggcucaauauuauuuuucaaaaauuuucugaggaugaggacuugguaauuacucacuuguaguggc

SEQ ID NO: 4195033 - RNA, 87 nt, Human
gccgcaucccagcugguugccauggugacccggcucuggccucuccgcagcagagaugagcaguuaccaaggaaccuggugcgcggc

SEQ ID NO: 4195034 - RNA, 99 nt, Human
gccgccaagggccgaggaaaguuuguuccaucagcagaagcccaggaaaugggaggcuccuggugcaaaguuucuucaggaagcccuggggcuguuggc

SEQ ID NO: 4195035 - RNA, 72 nt, Human
gccgcccgccucaggcucucucugccagccgugcggccaggcccgcgggguggucggggggagccgggcggc

SEQ ID NO: 4195036 - RNA, 56 nt, Human
gccgcccuucugugauccugacccuauuccaggcucaggaaacagcagggcuuggc

SEQ ID NO: 4195037 - RNA, 62 nt, Human
gccgccucuuccugaccgugugccaacgcuccaggcagccagcagggcuuagaggacaaggc

SEQ ID NO: 4195038 - RNA, 70 nt, Human
gccgccugagggagcuggagcagacgccgugggacuuuuccccugaguuauugcagcuuccuccuggagc

SEQ ID NO: 4195039 - RNA, 117 nt, Human
gccgcggcccccagcuuuuaccucuacgcgcgggccgggccgcugggcgcugccaucccaaaggcuccggagccugagcggcccagggccaggguugcgaagcggcggagucgcggu

SEQ ID NO: 4195040 - RNA, 62 nt, Human
gccggagccugcuuguugcagcugugggugaggacggcucuagcuaggugagcggcuccggc

SEQ ID NO: 4195041 - RNA, 71 nt, Human
gccggaggggcuggucuuuccacuuacucuggacaccagggaaggguucaggugggccugccccucugagc

SEQ ID NO: 4195042 - RNA, 55 nt, Human
gccggcccaccgccucccggucggaagcggcagugcaggugaggcggcggccagc

SEQ ID NO: 4195043 - RNA, 75 nt, Human
gccggcccagcucccgcaggcugcacagcuugggcagccagguccacgagccaucugcggggggacaggggcggu

SEQ ID NO: 4195044 - RNA, 76 nt, Human
gccgggaggcuggaugccuugggggaggaggaaacccacuuggauuucuccucagcaaggcagcuuuggcuccggu

SEQ ID NO: 4195045 - RNA, 76 nt, Human
gccgggccacacaggcgucgccugcucuugccaccagugccucaguggcagcagaacuggcccuguaucaggccgc

SEQ ID NO: 4195046 - RNA, 91 nt, Human
gccgggcgcagugacucacgccuguaaucccagcacuuugggaggccgaggugggcggaucacaaggucaggaguucgaggccagccuggc

SEQ ID NO: 4195047 - RNA, 58 nt, Human
gccggggaaacucaggcauuuccacuuuguuuagaaugggccaucacuuuccccaggc

SEQ ID NO: 4195048 - RNA, 107 nt, Human
gccggggaccgccaagccggagccaguggaguggggcgaagucggcgaguuggaaacuuccugcaaucguccacuccuagccuuuggcguucggcugguccucuggc

SEQ ID NO: 4195049 - RNA, 79 nt, Human
gccggggccuggcuucugaggcugaauggacuccgugaaaauggcagacacgggccuucucuucaggcgaggccugggc

SEQ ID NO: 4195050 - RNA, 95 nt, Human
gccgggucccggcuccccuuuguucccccgcugggcucggcgcuccggcgccgcccccucucgcggggcagcggagguuugggcccgggccgggc

SEQ ID NO: 4195051 - RNA, 71 nt, Human
gccguacagaccaguaguucucagcgccuuugcuuacccuggguugcucagaagacuuacugguuacuggu

SEQ ID NO: 4195052 - RNA, 57 nt, Human
gccgucgugaugaacacgccuccaccaguucccugagccauuucugucacguacggc

SEQ ID NO: 4195053 - RNA, 68 nt, Human
gccgugagaucagacacggcuugugacgcguguggacgcgugugagguugcuguuuguucgucauggc

SEQ ID NO: 4195054 - RNA, 61 nt, Human
gccgugcagcaguaacucccgugcagcaguaacucccgugcagcaguaacugcagccgugc

SEQ ID NO: 4195055 - RNA, 103 nt, Human
gccguggaguggaaggugaagcauucucuguagauggcuugagagaucaacaagggauauuugcauugcagugguuuacagggacugcuugcuccaauuuggc

SEQ ID NO: 4195056 - RNA, 68 nt, Human
gccucucagcuuuuagaaccgagccuuccgagaugcuuggagaguucuaccucugaaggcgagcgggc

SEQ ID NO: 4195057 - RNA, 64 nt, Human
gccucuccagucaacuuaaucucuuuauuuaaagaauagagugcauagagauauuugacugggc

SEQ ID NO: 4195058 - RNA, 74 nt, Human
gccucucccugcuuccuucaaguuuaucugcuggaaagagggguagacgagggaggagguagagccagagaggc

SEQ ID NO: 4195059 - RNA, 59 nt, Human
gccucuccucugaaguggugacccagaucucaguguguggcuaccucagaggagcaggu

SEQ ID NO: 4195060 - RNA, 91 nt, Human
gccucucugugacaggaugcaagcugccaccagaagagcaugaccuagugcaaggcagcucuuugagcaaggcagcucuuugcagggaggc

SEQ ID NO: 4195061 - RNA, 64 nt, Human
gccucugaaaguagguaucacuaucuccauuucaacagaugaugacacuugggcuuugagaggu

SEQ ID NO: 4195062 - RNA, 70 nt, Human
gccucugaaauauuugggcagauguuuccuguggaaaauauuccauagcgcugcccucuguuauaugggu

SEQ ID NO: 4195063 - RNA, 61 nt, Human
gccucugaaccaccaauuugcuacuuugcugccaguuugcaguugaauggucagacaaggc

SEQ ID NO: 4195064 - RNA, 85 nt, Human
gccucugacuuacaagcuagggaagcuugggcacaucaccgagucucucuaagccucaguuuccucagcuguaaaauaaggaggc

SEQ ID NO: 4195065 - RNA, 88 nt, Human
gccucugaucuugguaauguguuuguccugcagaaauaggagcucuauccugcacuaaacacacacuugguccaggagucagggaagc

SEQ ID NO: 4195066 - RNA, 82 nt, Human
gccucugcacagaugcugggaggcugagugcagcccuggaugcaggcauggcuggcuucucccuccccaucuaguuucaggc

SEQ ID NO: 4195067 - RNA, 66 nt, Human
gccucugcagagggcccuuauagggagauccaucuguaucuucuucagugccccucuaguagaggc

SEQ ID NO: 4195068 - RNA, 60 nt, Human
gccucugcccucgaggagcuuguguucucccaggagacacaggcagugaggcuagagugc

SEQ ID NO: 4195069 - RNA, 66 nt, Human
gccucugcuacaccggaauagugacauuugcccuucaguguuccuguacugcuguggcuuucaggc

SEQ ID NO: 4195070 - RNA, 99 nt, Human
gccucuggcagcugggguaauuuaaggcuucacuggagugggacaggucaccgcagguugagcuauaaaagcugccuccaguguaacuuugcucggggu

SEQ ID NO: 4195071 - RNA, 83 nt, Human
gccucugggucucugcagggcuuaccuugcucugaaaaaccauuugccagcagcguaggugacucugaacaggccggggaggc

SEQ ID NO: 4195072 - RNA, 72 nt, Human
gccucuuauggcccucagaguuugguuaaguugcagaaccuguuuaagccuguggugucaucuguaaggggc

SEQ ID NO: 4195073 - RNA, 69 nt, Human
gcauuuccuaggagauugaucacauuuaucaccauuuagauaucuaugugccaaagucuuccuaagugu

SEQ ID NO: 4195074 - RNA, 59 nt, Human
gcauuuccucuuuguaccuugacuaagccaaagcugggaaaucagcagggagggaaggu

SEQ ID NO: 4195075 - RNA, 59 nt, Human
gcauuucucaacuguauuaugcagaacuuuagaguuuugugaggugugguuaggugugu

SEQ ID NO: 4195076 - RNA, 67 nt, Human
gcauuucuggcagugaacacuuucaccauuacaggccauggugagacaaagcagcugacagaaaugc

SEQ ID NO: 4195077 - RNA, 102 nt, Human
gcauuucuuagaguaccucgaguaaacuuucgaaacacguauuucaaaacccuuauguguuuaacaucugguuuauacaauccaggaacuccuaaaaaaugu

SEQ ID NO: 4195078 - RNA, 72 nt, Human
gcauuuggugacaccgcaggcagaggggggacgccacagccagcucugcccgcggaugccacguccauuugc

SEQ ID NO: 4195079 - RNA, 106 nt, Human
gcauuuuaagugaagcuauuuauuuauacuuuauacuacaucauuaugguucaaaaccaaaaggaaucgugugguauaaaaugaaguauguuucugugaaaaaugc

SEQ ID NO: 4195080 - RNA, 100 nt, Human
gcauuuuacagcuucaugacaaacaguuuugugcccauaccuuagaaaauguggugcugaguuaaauaaaggcuguuugagcacuggagcagaaaaaugc

SEQ ID NO: 4195081 - RNA, 102 nt, Human
gcauuuuagagggucucaguuauuaucgcauucuaauuuuugagucagaagaguaauuuuccuagaaucaaagaaugggcuaguuggagauuuuuuuaaugc

SEQ ID NO: 4195082 - RNA, 72 nt, Human
gcauuuuaugggcuggccacugggucuggguagaagaaaggcccauucccaccaagcaggccaugcaaaugc

SEQ ID NO: 4195083 - RNA, 74 nt, Human
gccaaaaaggaggacugaaauaucuaaguaaccugaaagagauuaauaagaauaaaucaguuucucuuauuggu

SEQ ID NO: 4195084 - RNA, 63 nt, Human
gccaaaacaucagguuucuuuaugcugcuagaagucagauagacuuaguguagaaaccuuggu

SEQ ID NO: 4195085 - RNA, 72 nt, Human
gccaaaagagacaagggaccucuggagaggcacccgggagcgggcgucugcagggcccuuggcuccuguggc

SEQ ID NO: 4195086 - RNA, 68 nt, Human
gccaaaaucgcaucaacagaugggugacugucaauuagccauuuguuaaccaguguggauuucuuggc

SEQ ID NO: 4195087 - RNA, 81 nt, Human
gccaaacucuccugacaauuggcugucacuuauuuaacugccaccauccccaggagacagaaaaugccagaaggguggggc

SEQ ID NO: 4195088 - RNA, 72 nt, Human
gccaaagaccacaguguuuuagaaaagcuugagcagauccucugcuaaagagaaaaaaguacugugucuugc

SEQ ID NO: 4195089 - RNA, 80 nt, Human
gccaaagauagcuucagaauugagauaucuuaaggaaugaucuaugaaaguuguacucaauaucugacuaauaauuuggc

SEQ ID NO: 4195090 - RNA, 84 nt, Human
gccaaagggugguuccuagaauuacugaguacaagaaccuacuacuguaacuguggucuagggacugggaagccccaacuuggc

SEQ ID NO: 4195091 - RNA, 58 nt, Human
gccaaauacaguagucauugccauugccauuuugagcaucuacugcgcuguguugggc

SEQ ID NO: 4195092 - RNA, 82 nt, Human
gccaaaugcucuggguauuugcuaguucuccuuuuuugcucuguacucuguggauauggccuugauccuccagagcacuggu

SEQ ID NO: 4195093 - RNA, 62 nt, Human
gccaaauggcuaaguaugcccuggggcagagagaagccucuggggcagcugagucaugaggc

SEQ ID NO: 4195094 - RNA, 69 nt, Human
gccaaccccggugguggucccuuaaaaucuguccuccagauggccaaggaccacgcaucgggggagggc

SEQ ID NO: 4195095 - RNA, 68 nt, Human
gccaaccucuccuggccgggcuguccccugguaaaaugaggugggagcacuggccagcagaugagggc

SEQ ID NO: 4195096 - RNA, 79 nt, Human
gccaacuucauauuguuuccacuagauaucauuuuaaauauuccugugguuucgugguccuaagaauaugaaggcaugc

SEQ ID NO: 4195097 - RNA, 64 nt, Human
gccaacuucucuauuuaguauuccuuguuuccuguucagaccaaauccuuaaugaggaguuggu

SEQ ID NO: 4195098 - RNA, 70 nt, Human
gccaacuuucacagcuugaaaaguauugauaccacugauggaugaaauguuuuccaagcauggaaauggc

SEQ ID NO: 4195099 - RNA, 75 nt, Human
gccaagaaaagaaagaggagugcugcauguuggcagaucucagcuucaaaugcagcugcucauucucucagucuc

SEQ ID NO: 4195100 - RNA, 62 nt, Human
gccaagacuugaacccaggccugucuuccucuaaggcacaggcugaaaguuaaguucugugc

SEQ ID NO: 4195101 - RNA, 64 nt, Human
gccaagagcucagaaacccuugcugugugccccacagcagcagaagguaaaucugagccugagc

SEQ ID NO: 4195102 - RNA, 92 nt, Human
gccaagauaugauucuggacacucuugauaaagcugugaguuacuauauuuaugucacauuuguguuuuauuagagaaaguuauaucuuggu

SEQ ID NO: 4195103 - RNA, 80 nt, Human
gccaagcaaagggagguacuucuggaauaggauuauaaagugcaaaggcugcgcccuuucugauggccucccagccuggc

SEQ ID NO: 4195104 - RNA, 80 nt, Human
gccaagcaaaguaaggggcaucaguugcacauuuugccaucaagcaaagcaacaaaaugaugccuugcagcuuuuauggc

SEQ ID NO: 4195105 - RNA, 74 nt, Human
gccaagcaaguugaaugauaauacuccccugggacaaaaagguguuccgauaaguuauguaacuugcucaaggu

SEQ ID NO: 4195106 - RNA, 109 nt, Human
gccaagcacacagacccaccccuggucccaugaggaggcuguggagcacuccaucugugcucgggugaaggguuaagcugccuccccucaugggagggagggugcuggc

SEQ ID NO: 4195107 - RNA, 73 nt, Human
gccaagcacuggagggguacuuucaccuaggccaacaaacuuaauaagcagagaaacccuucaguguuuuggc

SEQ ID NO: 4195108 - RNA, 103 nt, Human
gccaagccagcauccuuugcacuuaaaguccagacuccuuugcguggauucugguccacaggacggaggucuggccgcugccaguguugcugcuuucaauggu

SEQ ID NO: 4195109 - RNA, 76 nt, Human
gccaaggagcugaagucucugcacucugccuucugucuggccacugggugucacucuucaucuauguuccuuuggu

SEQ ID NO: 4195110 - RNA, 65 nt, Human
gccaaggccaugcacauccuaggcagacccagacauugccugagcauggagguucauggccaggc

SEQ ID NO: 4195111 - RNA, 84 nt, Human
gccaagggucugccccacaggcucaguugcagagaaucaggacggcaagcagaagccucaggggcauauuugagaccuugcugc

SEQ ID NO: 4195112 - RNA, 87 nt, Human
gccaaguacagaaucagagugaaaacugagcucaaagcauauuaguugguucugagugauauauuuacucuuuguucuacacuuggc

SEQ ID NO: 4195113 - RNA, 76 nt, Human
gccaagugcggaucaugggacuucucagccuucagauacauauggggcugagacagucccaugaucugcaguuggc

SEQ ID NO: 4195114 - RNA, 61 nt, Human
gccaaucugcagggaggcucucagcagugcccuuucagaaccagcccagcagaugaaaggc

SEQ ID NO: 4195115 - RNA, 77 nt, Human
gccaauggaaugucucuuguuguugauuuuuuaccauuuagcuuucuaagucauaagucaacaaaggagaagugagc

SEQ ID NO: 4195116 - RNA, 95 nt, Human
gccaauggccacaaguuagcagguggcagaggugggaucugguaccagccagucugacuccacugccacgcucuuaaacuccaugccagagaggc

SEQ ID NO: 4195117 - RNA, 97 nt, Human
gccaauggcuuuggccacggggacccagacagucaagaggccugcugcaacccugaagaguccucccacagucuggcuccaggaccacaacauuggc

SEQ ID NO: 4195118 - RNA, 87 nt, Human
gccaauguccgucauuaucaauggaaucuuucaaucaggaaaaaucucacgagugugaggaauuggaagaccaugggugacaucugc

SEQ ID NO: 4195119 - RNA, 65 nt, Human
gccaauguguggaguggaagucaucuuuuucuuaucacacccaaugacccauuuucaguauuggc

SEQ ID NO: 4195120 - RNA, 68 nt, Human
gccaauguuuuaaaagagauugagaaucuggaauuuuauauaauuuuuuuuaacuuuuagacauuggc

SEQ ID NO: 4195121 - RNA, 64 nt, Human
gccaauguuuuuccuuccuuaauaaaguguuccaaaacaguaugcuagauggaaaaauauuggc

SEQ ID NO: 4195122 - RNA, 60 nt, Human
gccacacaaggcugggacaagugcugugguucuacagucauguuacaagcuuugcagggc

SEQ ID NO: 4195123 - RNA, 121 nt, Human
gccacacagagccugguaagcagcucugaaggcauucugucaggcccuggcagccgugacauucuagaugauuuuugagcagcugggcugacucagggcugacucacuuggcaaugugggc

SEQ ID NO: 4195124 - RNA, 63 nt, Human
gccacacugcuucuuugagccuguggcccggcaagguagucaggcucaugggauuagguuggc

SEQ ID NO: 4195125 - RNA, 65 nt, Human
gccacagacagagagucuaguguagugcuaaaggugcaugagcucuggagauccucugccugggu

SEQ ID NO: 4195126 - RNA, 75 nt, Human
gccacagauuuuugguaaauaauuugguuaccacauuacaucuugaaggacuaaauuauuucacuaauugugagc

SEQ ID NO: 4195127 - RNA, 93 nt, Human
gccacagcaccucggcaggcguggcuuuucaccugcuccucugggacagaucugcagggggcagcguagaaaaugagucccugagagcauggc

SEQ ID NO: 4195128 - RNA, 56 nt, Human
gccacagggauuguuuugugaggggaggcuguuuuauaauuaaugaucucuguugc

SEQ ID NO: 4195129 - RNA, 58 nt, Human
gccacagguggccccgagggagugggcugauuuggccugagccuccaucccccuuggc

SEQ ID NO: 4195130 - RNA, 113 nt, Human
gcccccuucucugcagcuccugagucuccacgccccguccaccccuucugcguacccaccccucccaagcacuggauggugaggcgaggacuaggcccugcagcuuguggggc

SEQ ID NO: 4195131 - RNA, 109 nt, Human
gcccccuuuccaugaguguggaugggcggggcaagccgucggggagccuggggaagcucagcccugaggggcuuacuuugcccguggaagccagugugaagguuagggc

SEQ ID NO: 4195132 - RNA, 74 nt, Human
gcccccuuugcuggugauuaaauccugaagguacacgaaguauuucagugaaugaauggcuaacagaaaagggc

SEQ ID NO: 4195133 - RNA, 66 nt, Human
gccccgacauggauuauuuugugccuaauuuuugcaucugguuuuggccaagaaaguucugugggc

SEQ ID NO: 4195134 - RNA, 85 nt, Human
gccccgaccaucccgccccgccgcgauccucugcgggccgaagcugcaggcgcagagccccauugcuggcggggcaggcgggcgc

SEQ ID NO: 4195135 - RNA, 57 nt, Human
gccccgagugucaauaguaccaagguucggaagccauggucugaaaguauuuguggc

SEQ ID NO: 4195136 - RNA, 80 nt, Human
gccccgccugagagcuuguuagaaaugcaggcgcugcuaaucagaagcugccuuuaacaagaucuccagaugaguggggc

SEQ ID NO: 4195137 - RNA, 79 nt, Human
gccccgcggcauuuaggagaagagggucagaguucaaggagugaauuugugaaucugucucuugaaaaugccccugggc

SEQ ID NO: 4195138 - RNA, 69 nt, Human
gccccuacagccccagcccgcagcccacguggcacccuacagggcugugagaguggggcugcuggaggc

SEQ ID NO: 4195139 - RNA, 73 nt, Human
gccccuaguagcuguucucuguaaauuggaguuaauaaaucccuaugagaaguggcugguauauaacgggugc

SEQ ID NO: 4195140 - RNA, 62 nt, Human
gccccuauggagcucuucuggaauuaauauucaugauucuauggaaggcauaaggaaugggc

SEQ ID NO: 4195141 - RNA, 58 nt, Human
gccccuccagaggcgacuugcaucacggagaugucggugaugauggcuugcuggaagc

SEQ ID NO: 4195142 - RNA, 71 nt, Human
gccccuccccgcuggcugcccugggucucccuuuguugauaugacuacccacagcugcacagaggaggugc

SEQ ID NO: 4195143 - RNA, 129 nt, Human
gccccucugcagcaacuucuaaaauuccuucuuuaacucuuuaguuugaaauccacauaugauaggguuuaaugcaggaggacuaaagggaugaaggacauuaaacaggaucaggauguccauggggac

SEQ ID NO: 4195144 - RNA, 105 nt, Human
gccccucugguggucccccgcugagucuuugguaaagucugcugcaucugccaauucuuuugugagcagauuuguucuaggggugugggggacuaagaaaggggu

SEQ ID NO: 4195145 - RNA, 122 nt, Human
gccccugcgcaaggccucacggcuccaggcuguuggagguaccugcccacucaaccugggcuggcuguuggagguaccugcccacucaaccuggcgggcugugcguggcuugugcuuugggc

SEQ ID NO: 4195146 - RNA, 86 nt, Human
gccccuggaguccucgguuccugcgcccuucucgcccgcggcacccucucgcgaguccacuggggggcgcaggcgggcuccagagc

SEQ ID NO: 4195147 - RNA, 61 nt, Human
gccccugggcuauguauagcuggacaguauaaaggaagcagcuggagagccaggcaggggc

SEQ ID NO: 4195148 - RNA, 75 nt, Human
gccccuguuccuaaugucuacuuuaguucacacaguggauaccacucggacuaccuggauauuggaacaaauggu

SEQ ID NO: 4195149 - RNA, 78 nt, Human
gccuuuuccaaauuacugaucuacaaaauccaugaguauaaucaaaugguuguauaaugucacuaagcuggagauggu

SEQ ID NO: 4195150 - RNA, 122 nt, Human
gccuuuugcauccuagagagcccagaggaaucagagaagguguccaucaccaacuguucuugguaacaugcagaggagaugaagauacuuuccuuaggguggugggaaacuuugaugaaggu

SEQ ID NO: 4195151 - RNA, 102 nt, Human
gccuuuugcuuagccuucaugggccaagacucagccccauggccucaaacuaacugcaaaagaggcugggaaauguagucuuccccaggaggagcaaauggu

SEQ ID NO: 4195152 - RNA, 103 nt, Human
gccuuuuucauagucaaaacauacuuuuuagaucugccuucuugggauguauucaaggaugcuagccguguuugagacuguaaauaugucuagugaauagggc

SEQ ID NO: 4195153 - RNA, 56 nt, Human
gcgaaagggguauauacauguaggccagcauacaugcauaaacuacuucuuauugc

SEQ ID NO: 4195154 - RNA, 64 nt, Human
gcgaaauggggccagggaggaccagacaacacgcaaaggcgccuuucugcucuggcccuugugc

SEQ ID NO: 4195155 - RNA, 78 nt, Human
gcgaaguguagugggcugugaucaggaugcagucuccuuccugcccaucucugugccaucauugccccugaacuaggc

SEQ ID NO: 4195156 - RNA, 55 nt, Human
gcgagaaacuaagugcccuuugcgggugacugcgcagguaccucugauuucuugc

SEQ ID NO: 4195157 - RNA, 68 nt, Human
gcgagcauagucaacacgcaaagccgacuccgccagauaaggaguugcuuuggaaacuggcccugcgc

SEQ ID NO: 4195158 - RNA, 71 nt, Human
gcgagcaugugcaugugugcacugauaauauguaccccugcaagucagagagggcacgugcacaccuacgc

SEQ ID NO: 4195159 - RNA, 105 nt, Human
gcgagugcuuaccuugauuaccuuguugaauccucaguaacucuacgagguaggugccauuuuacccaggaggaaacugaggcucagagaggcuaaguaacuugc

SEQ ID NO: 4195160 - RNA, 71 nt, Human
gcgaugggauggggaaggucggaggaaauggcugucuguguaaacccucugccugcccaccgacccauggc

SEQ ID NO: 4195161 - RNA, 86 nt, Human
gcgcagcuggcaugacucagaaacaggauucaaaaccggguaggcugguuuuagaguccaaguucuucacugacagacuguacugc

SEQ ID NO: 4195162 - RNA, 82 nt, Human
gcgcaggccuacaggugaauggcucuagaauaccccucaggcaggccacuuccuguucuagaagcuuucugaggcacuuugc

SEQ ID NO: 4195163 - RNA, 67 nt, Human
gcgcaggggcccugaucgcccccagaggugcugagcgcacagggcaguggcugcagagccccggcgc

SEQ ID NO: 4195164 - RNA, 64 nt, Human
gcgcaggucuggguugauggccugggugaucucacgcauuaggcauuggaaggucagcuugugc

SEQ ID NO: 4195165 - RNA, 58 nt, Human
gcgcaggugucuucagcaggaugaguggaggaccacucagcucuacacacaccugugu

SEQ ID NO: 4195166 - RNA, 130 nt, Human
gcgcaguuugauuugaauuucagauaaacauugaauaauuuuuucguauaaguaugucaugugcaaugcuuaggacaugcuuguacuaaaaaaauauuuauuguguaucugaaauucaaauuuagcuggc

SEQ ID NO: 4195167 - RNA, 86 nt, Human
gcgcauggguugguucgauugugaugcaagauugugagaagugaccacaggacucuugucaucaucaguuguaaauauuugugggu

SEQ ID NO: 4195168 - RNA, 66 nt, Human
gcgcaugugccacuaagaugcacagauuuccggcaacacaaugccugucuccuguuggcacauggc

SEQ ID NO: 4195169 - RNA, 55 nt, Human
gcgccaugaugucagcaacacaauuuuaugugucgauguaccugggucauggugc

SEQ ID NO: 4195170 - RNA, 58 nt, Human
gcgccaugcagcgcggugggcgggcagguuuccagcagcuccuggugcugcguggcgc

SEQ ID NO: 4195171 - RNA, 84 nt, Human
gcgcccagagccugugccugccccggggagggaaggaagugccgucuuuggccuccuccuucccgagggucucuggcugggcgu

SEQ ID NO: 4195172 - RNA, 64 nt, Human
gcgccccagggugagaaaaggcuggaugcauaaugcauucacauugagcuucacuguggggugu

SEQ ID NO: 4195173 - RNA, 84 nt, Human
gcgcccucucuaaggcacucugccaggucuccugauuuccaguuuccgggaggugaggccggcuagggugccccgagggccugc

SEQ ID NO: 4195174 - RNA, 66 nt, Human
gcgccgcccgcugcagcgccgccguccagggaccgggcccuggaggccaggaaggcagcgaggcgc

SEQ ID NO: 4195175 - RNA, 58 nt, Human
gcgccgcgaagaagccgggaagaguuugccaggcuugccucugcugcccgccggcugc

SEQ ID NO: 4195176 - RNA, 57 nt, Human
gcgccgggagccaaggaugcuguugcucccagggagaggguguccuggcugcggcgc

SEQ ID NO: 4195177 - RNA, 122 nt, Human
gcgccucgggggcugggauugggggugguggcugacggagaaggcugggcagcagagcgccuaugacauccagccccuuguccgguagccacugcuuaccuugacccccuccuccgagaugc

SEQ ID NO: 4195178 - RNA, 82 nt, Human
gcgccucugcugagaccaugaccucccauucaucacagcuugccggccaggguuaugaggaggucaggccuuacaagagugc

SEQ ID NO: 4195179 - RNA, 55 nt, Human
gcgccuggcacacagcaagggcgggaaaggcuccucccucugcuaaccgcggcgc

SEQ ID NO: 4195180 - RNA, 99 nt, Human
gcgccuggcggauccaggcucuccucgggucgcaggcgggggcugggggccgcgggcuccaggccauggcugcggaggugggccucgagcugcaggggc

SEQ ID NO: 4195181 - RNA, 87 nt, Human
gcgcgcagccuuccucccgagcucccugcgcucuauuccugucccgccgagacgacucccuggagccagcgagccgaggcggcgugc

SEQ ID NO: 4195182 - RNA, 129 nt, Human
gcgcgccgcggucugggccugcgcgagaggcugccgcccgcgucgggccugggccuacgcgugucuggccugggccugccggugcaacagcaguugucgccaccgguccuaggccgcgccgagcgaguc

SEQ ID NO: 4195183 - RNA, 62 nt, Human
gcgcgcgcgcccagggccucauggccuaucguugggcucgcagaucaccugggggcgugugc

SEQ ID NO: 4195184 - RNA, 56 nt, Human
gcgcgcucucuccagccuccccgcccgggcagggggaacaccgggcagaggcgcgc

SEQ ID NO: 4195185 - RNA, 67 nt, Human
gcgcggagguagcuggaugcggcccucucuccccgcaggagacgcggcuguucggcggcccucgcgc

SEQ ID NO: 4195186 - RNA, 76 nt, Human
gcgcggcaaguaggcaaggcucggcaaugugcggcuccuuccacgagggggcggccgagcacuggccucgccucgc

SEQ ID NO: 4195187 - RNA, 65 nt, Human
gcgcgggcaggccuuccgaguggaaccucuaugccgacaucgacgccgccuggcaggcccugcgc

SEQ ID NO: 4195188 - RNA, 86 nt, Human
gcgcgggccagcuggggccgggucugcguucccaggagcugccaccguuccagggagcaagucaggccgggacguagcgccugcgc

SEQ ID NO: 4195189 - RNA, 57 nt, Human
gcgcguaucgccgcucuggauuuaaggacaauacuuuccccuggcagccaugcgcgc

SEQ ID NO: 4195190 - RNA, 101 nt, Human
gcgcuauccugggacagagcugugggccccagcccuguauggaauggagaucccagauccugagggcucggggcucauggugccuauccugggcauggagc

SEQ ID NO: 4195191 - RNA, 62 nt, Human
gcgcucgggguuauguuugugcaggaacaccagcuccugcugcuaccuggcccacgugcugc

SEQ ID NO: 4195192 - RNA, 111 nt, Human
gcgcucugcagugacauggaguauuuuugagcugugaacauagcggcaucuguuggacacuguaugaauuauuagcucaagggaguucacaguuuuauuauugcauggugc

SEQ ID NO: 4195193 - RNA, 72 nt, Human
gcgcugacauuuuuacauuuuauucguuuauuucuuggcucaggaaugagaauguaagugaagagagggcgc

SEQ ID NO: 4195194 - RNA, 91 nt, Human
gcgcuggcuuuugcgucaucuccucccgcgccgagcucgcuccauccuggcgcaguggcgccggcucggcccgggaggagggagaaggcgc

SEQ ID NO: 4195195 - RNA, 55 nt, Human
gcgcuucugaauggcuaauggucucuaagcguaggcccuaggcuaccuggagcgc

SEQ ID NO: 4195196 - RNA, 89 nt, Human
gcgcuugucucugaggcaucugcagagcuuggugaucugcccaggaaugagcucauacauucugcagauuccagggaacagacaagagc

SEQ ID NO: 4195197 - RNA, 77 nt, Human
gcggaacuuuaaguguggaauuuuggagccagaucacccaccagguggcuaacaguuaagauuucaucauugguagc

SEQ ID NO: 4195198 - RNA, 62 nt, Human
gcggaagagcuagagcugacccgugaguuaugccucaugcugaggcagcucuugucuucugc

SEQ ID NO: 4195199 - RNA, 80 nt, Human
gcggaagggccggccaggagguggcaggacuugccuuacuacugagucgccggcauccccgccucuuccggccucuccgc

SEQ ID NO: 4195200 - RNA, 103 nt, Human
gcggacaagagguggggggacaagagguggaaucagugaguggaauuuguguuucaucaauucuacauugguucacauuuuagcgucccugaagucgaaaugc

SEQ ID NO: 4195201 - RNA, 90 nt, Human
gcccugggaguugccgucuguccuggcuggaccuuccggaaacccugcggucugaacacuggcugguccucggggacagcagcccugggc

SEQ ID NO: 4195202 - RNA, 58 nt, Human
gcccugggccccgaacugcugaggcuccaugagguccagcugugccuggcccaggagc

SEQ ID NO: 4195203 - RNA, 59 nt, Human
gcccuggggcgggcggaaggccgggugguggggccggccugagagcccuagccaggcgc

SEQ ID NO: 4195204 - RNA, 56 nt, Human
gcccugguaauaguggaauuuucuccagcaguggggagacagcccagugccagggc

SEQ ID NO: 4195205 - RNA, 76 nt, Human
gcccugucaggcagucacaggggagacugggcugcuacacaaugugcccaucucauuacuguguugcugacagcgc

SEQ ID NO: 4195206 - RNA, 64 nt, Human
gcccugucaucaaguucugucacauuugucuggguggagagcccaggggcaggaagaacagggc

SEQ ID NO: 4195207 - RNA, 92 nt, Human
gcccugugagucagcccagagccccggccauguuaggguccccuggcacagucugccuuggcuaaggggcccuuggguugagucaucagggc

SEQ ID NO: 4195208 - RNA, 79 nt, Human
gccgcuguuucuuccucuccucacaugagucacaugagccugagagccauguugaaggagaagaucuggagcuagaggc

SEQ ID NO: 4195209 - RNA, 101 nt, Human
gccgcuuucuggaguagucagucuuacauauuugaacaauaccacccugguguaauuuuaaaaaguaagagcuugauucuuuaaaaaacacuuagccaggc

SEQ ID NO: 4195210 - RNA, 88 nt, Human
gccggaggcugagccagaucugucuaugagugccaaauugcugucucagcgcugcugcugaugcauagucugcucgccugccccaggc

SEQ ID NO: 4195211 - RNA, 67 nt, Human
gccggcagcagccauccuuagagaaagagguaaacucuccccucugcagggggcuugacucuacggc

SEQ ID NO: 4195212 - RNA, 74 nt, Human
gccggcccaugguggcuuggaccagucacagugguccgggggcccagaugaggucugagcagaguggggugggc

SEQ ID NO: 4195213 - RNA, 91 nt, Human
gccggcccuuccuucaaguuuaauugagauguuuagaguugucggugcuuuugaacaugaucucaguaaacuuugcucauugauggcuggc

SEQ ID NO: 4195214 - RNA, 80 nt, Human
gccggccguaccuccgagagcaugacguacuguccccuucugcccaacgugaugcucaggaggucauagauggcugcggc

SEQ ID NO: 4195215 - RNA, 91 nt, Human
gccgggauggucuugaucuccucaccuugugaucucccugccuuggccucccaaagugcugggauuacaggcgugagccaccgugcccggc

SEQ ID NO: 4195216 - RNA, 76 nt, Human
gccgggcgggcccuggggggagcugcguccagcagagcugcugggugguugcuccucccgggcucucaucuccggu

SEQ ID NO: 4195217 - RNA, 55 nt, Human
gccggggauugagguaugacucagaaucccugauguccccuucuugaugccuggc

SEQ ID NO: 4195218 - RNA, 58 nt, Human
gccggguacauaucaaggcuuuauuaacauuuaauuaagcauuuauuaugugccaggc

SEQ ID NO: 4195219 - RNA, 56 nt, Human
gccgguauuccauauccugggagaugccucugauccuuggaugugcauggccgugc

SEQ ID NO: 4195220 - RNA, 65 nt, Human
gccggucccuccugcgagacaccggugugccagcugucaugucaccuugcagggcuggggcuggc

SEQ ID NO: 4195221 - RNA, 63 nt, Human
gccggugagccucacugcccgcugcugccgccuccgcagagugggcaggcagggugcgcaggc

SEQ ID NO: 4195222 - RNA, 60 nt, Human
gccggugcaggugagugcaggggcucacaagggugaguccaggugcuuaccuggacaggc

SEQ ID NO: 4195223 - RNA, 64 nt, Human
gccgguggcagaguuggagguggaagacagcaugucugucucccacugccaccuugucuccugu

SEQ ID NO: 4195224 - RNA, 62 nt, Human
gccgguugcugugguaguuaauauuauuugucuugcuugcgaaagaggccucagcagcuggc

SEQ ID NO: 4195225 - RNA, 59 nt, Human
gccguggggcuuccuggggcaaguuggccaucccagcccucauggaacagcuccuaggu

SEQ ID NO: 4195226 - RNA, 78 nt, Human
gccuaaaccuuuucagcugaauggagcuuuucuucucaguggaauugaguuccgcauucaguaucaaaaggugccagu

SEQ ID NO: 4195227 - RNA, 63 nt, Human
gccuaaagcccacugggcugagggcuggaaggacgagccugacccaccagcccaggggcgggc

SEQ ID NO: 4195228 - RNA, 65 nt, Human
gccuaacacagugacuggcaccuaguaugugccuaguaaauauuugucaauucacuguucauggc

SEQ ID NO: 4195229 - RNA, 103 nt, Human
gccuaauuguuucccuucuucuguggauguuggaugcaugcccuuuaucuuuugggguuuggaugcauuuccaucucauagaagcacucucuacacuguaggu

SEQ ID NO: 4195230 - RNA, 61 nt, Human
gccuacaucacugaugccaccacuccauuccuaggggguggugccacagcugaagucaggu

SEQ ID NO: 4195231 - RNA, 68 nt, Human
gccuacucuguguaagaccagugcuggguucauggggaauccaacauggguuaugcauauuguuuggu

SEQ ID NO: 4195232 - RNA, 120 nt, Human
gccuacuucuugguuuuuacagauucuuugcuuuuaaaaaggaaguugguaaguucugcuugacuaaguuaguccuuuuuaaaaguuguguauucauguagaaagcucugaaaaguaggu

SEQ ID NO: 4195233 - RNA, 55 nt, Human
gccuacuuuuucaugaaagcagcuaacuagaucggcucuuaaauguaaaguaggc

SEQ ID NO: 4195234 - RNA, 128 nt, Human
gccuagaagaaugccuggcacacaguaaguacaaagauagggaccugagugaaugagugcaucuuuuauucuucucuagaacacauaaucaccaaguccuuucacagcugaccaccacauucaggggc

SEQ ID NO: 4195235 - RNA, 59 nt, Human
gccuagagaaaaagccucugcagcgugaugugauguggacaggcuauuuucuuacgggu

SEQ ID NO: 4195236 - RNA, 63 nt, Human
gccuagaggcuuccugcaggucagggccauggaaggcuggggccagugaggaggcuuucuggc

SEQ ID NO: 4195237 - RNA, 76 nt, Human
gccuagaucaauggugggguuccaugaauagaagagaucacagauucucuuuuucacauugucccagcacuagcgc

SEQ ID NO: 4195238 - RNA, 65 nt, Human
gccuagccccaguaguccugcaggguaggagcagcugccugcuguagggccccuggggccuuggc

SEQ ID NO: 4195239 - RNA, 76 nt, Human
gccuaggaagauagguuuuaugucuggguuagauagcgcugucuagagcuggaguagaaugugcugguuccugggc

SEQ ID NO: 4195240 - RNA, 58 nt, Human
gccuaggaguggggauggcgguggcgggaucaugcagcgcgccucgccacccugcggc

SEQ ID NO: 4195241 - RNA, 57 nt, Human
gccuaggaucaaccacaugaaaagcacuuagcauaugccagguacugauccuagagc

SEQ ID NO: 4195242 - RNA, 58 nt, Human
gccuagggguaagaguacuggccuagaagauggaagccuugucucucaccaccagagc

SEQ ID NO: 4195243 - RNA, 83 nt, Human
gccuaggguagggcacugguucuaaaauuauggccccuggaccauaucacuagagaaguuguuaaaaaugccaauucuugggc

SEQ ID NO: 4195244 - RNA, 68 nt, Human
gccuagguagggaccaccuuggggaggaagccaaaaucacacugcucacccgagagccccugccccgc

SEQ ID NO: 4195245 - RNA, 72 nt, Human
gccuaguacagugcucuguaaguuuuuguuaaaugaaauauuuuuuuaaauuccuaggguauugugcuuggc

SEQ ID NO: 4195246 - RNA, 78 nt, Human
gccuauaggaaguauucaaagacugaugaguucauaucaaaagaucuuaggagccagcuugaaggaguuuccaugggc

SEQ ID NO: 4195247 - RNA, 73 nt, Human
gccuauuuauucugagccugcuguagcaagggaguccaccacuaucacuugcguuuuggcagagacucaaggc

SEQ ID NO: 4195248 - RNA, 85 nt, Human
gccucacacugacuuccaggaacagcagagggacuuggacgccucuccaggcaggcaggccuguuccuggaaagccagguggggu

SEQ ID NO: 4195249 - RNA, 55 nt, Human
gccucacagacugacugaaagccggugaacacaugugccagcagaaugaugaggc

SEQ ID NO: 4195250 - RNA, 62 nt, Human
gccucacagugugaaggucagucacauggugugugaaaaacccuugucaccuguaaaggggc

SEQ ID NO: 4195251 - RNA, 74 nt, Human
gccucacccauauaagaaucggucgcaacagaggaggacauucucuggaaaacugaaauucuugggacagaggu

SEQ ID NO: 4195252 - RNA, 61 nt, Human
gccucaccucuggccuaauugccaaacagccauggagugggcaggccagagguuugauggc

SEQ ID NO: 4195253 - RNA, 58 nt, Human
gccucacgccugcccccaaccucccgguguagggguggggcucuggcaggccugaggu

SEQ ID NO: 4195254 - RNA, 58 nt, Human
gccucacugucacuuauaguggucaaggaagauuucagagagcaaguggcauuggggu

SEQ ID NO: 4195255 - RNA, 78 nt, Human
gccucagaaguauaggagacaaacaagacugacuauuuagggccuucucuugauuguuuucugaccuuauuucuuugc

SEQ ID NO: 4195256 - RNA, 89 nt, Human
gccucagcaccccauacaucuuugguaaaugaaccugaacuuccagcugucauuauagaguuguauuuuaggaaaagugcuguugaggc

SEQ ID NO: 4195257 - RNA, 73 nt, Human
gccucagccugaucccacggggagcucuagagcaccaaugggaucauagaguuggcccacguguaggcgaggc

SEQ ID NO: 4195258 - RNA, 104 nt, Human
gccucagcucaugcccaaacccauucuccuaggaucagggguccucuuuuagcuccagagagccucugucauggagagaagcuuguuuguucacugucuuaggc

SEQ ID NO: 4195259 - RNA, 78 nt, Human
gccucagggcuggagccacagcugggagggcucccagauccugaccauauccucccagaggcugagccaggccugggc

SEQ ID NO: 4195260 - RNA, 79 nt, Human
gccucagguccagggaauggcaugacuugcccaaggccaccuggcaggguaagagcagggccagguguccggccugggu

SEQ ID NO: 4195261 - RNA, 65 nt, Human
gccucaggugguuguuuggauucuaacaagacaaugcuuguaaaacacucagcaccuagcaaggc

SEQ ID NO: 4195262 - RNA, 83 nt, Human
gccucagucucccgaguagcugggacuacaggugcccgccaccaugcccggcuaauuuuugguauuuuuaguagagacggggu

SEQ ID NO: 4195263 - RNA, 105 nt, Human
gccucaguuuuuccugucuuggaccucucugcaggggagcucaaguguccuuaugaauacuggcuuccuccagagcaggagguccuggacaggguaagcagaggc

SEQ ID NO: 4195264 - RNA, 130 nt, Human
gccucaucaagcucuggccuguuuuccacuucccugcccugagcugagguggcugccuuaguaaccgcacagauguggugacacaggcagcucccagcacggcugaggggacaucucagaccccagagcc

SEQ ID NO: 4195265 - RNA, 64 nt, Human
gccucaucauauaguaacuugugaaccacagggaaaccuucacguuuuacugagugagauaggu

SEQ ID NO: 4195266 - RNA, 74 nt, Human
gccucauccuccaaaguagcugggaccacagacaugcaccaccaugaccccagcugauuuuugcagagaugggu

SEQ ID NO: 4195267 - RNA, 81 nt, Human
gccucaucuaagagauuccuucccugaccucucucaucucuucacaccuagguuuccacucuaggaauuucucagggaggc

SEQ ID NO: 4195268 - RNA, 62 nt, Human
gccucaugauuccagaugaauugcauaguuaaauuuaaacuugcaacuuuaaauggaaaggc

SEQ ID NO: 4195269 - RNA, 68 nt, Human
gccucauuuaaccuuaguuauguccuuacacgcucuuucgcuaaagacaaacccacuaggguuagggc

SEQ ID NO: 4195270 - RNA, 55 nt, Human
gccuccacagugcagucauuccuugaucacaaaguuucugccauacugugguggu

SEQ ID NO: 4195271 - RNA, 84 nt, Human
gccuccacauuccugcccucgccacuacaguuacagagaaauuaaaaaaccuuucauuguacaacugaggguggaauuguuggc

SEQ ID NO: 4195272 - RNA, 76 nt, Human
gccuccagcauuuuucaauagaauuacugccuuguuuaggaagaaucuaauucuuauuauuuaaagugcuguuggc

SEQ ID NO: 4195273 - RNA, 66 nt, Human
gccuccagcucagcuuccugggugugucagagaggcgugccaggagccagagcugaggaaugaggc

SEQ ID NO: 4195274 - RNA, 55 nt, Human
gccuccagcuggggcauuucagcaucaagaaacugccugcccaugugcugggggc

SEQ ID NO: 4195275 - RNA, 73 nt, Human
gccuccaggagcaccaggccugugcccuuccacgucuuaagaggaggcuucagugacuggugcccucaaaggc

SEQ ID NO: 4195276 - RNA, 56 nt, Human
gccuccaggauaagucagggccuccuccugaagccuugauucacucuguggaaugc

SEQ ID NO: 4195277 - RNA, 62 nt, Human
gccuugguuuguuuauacaaaagauccuauaggugaggaucaugaaguauaaauaggaaggc

SEQ ID NO: 4195278 - RNA, 90 nt, Human
gccuuguaugguaaugcugauucaagccaccacauacugcagcauuagaaguuuagcugugauuuggggguuggaucagaacuaugcagc

SEQ ID NO: 4195279 - RNA, 73 nt, Human
gccuugucuagaauacucguauuauuccccuggcuuauuaaguaaugguaaauaauaccaguaucuaagaggu

SEQ ID NO: 4195280 - RNA, 56 nt, Human
gccuugugaauccacaguagcuauggugacaagccugcugcaacucuuuagagggu

SEQ ID NO: 4195281 - RNA, 86 nt, Human
gccuuguugcgaagguaugcuuuauuauuauuggguugcguuucauuguauuguaaucccuacuagagcauaccguacggcauggc

SEQ ID NO: 4195282 - RNA, 57 nt, Human
gccuuguuuuucccuucuaggcucggcucccgagcucugcaggagagugggcagggc

SEQ ID NO: 4195283 - RNA, 68 nt, Human
gccuuucaaaguuuugccaugcucgugguaaguugcuagagagcaguggagcgagauguuuaaaaggc

SEQ ID NO: 4195284 - RNA, 70 nt, Human
gccuuucaucagcucaucugcuccuaggauccacucuuccucuggcuggcaccugaucugagcccgaggc

SEQ ID NO: 4195285 - RNA, 55 nt, Human
gccuuucccaaugggguggguccacagggacuaguggccucugcuggggacaggc

SEQ ID NO: 4195286 - RNA, 82 nt, Human
gccuuuccucaggagagcuccuaugccucccacacacagcugggccgccguguggucugggaagcugucucugagcagaggc

SEQ ID NO: 4195287 - RNA, 101 nt, Human
gccuuucgguucaggaccuacagccccuugcacuuccccacgccuguuacacaagcccaggcugggagcagagggcgagcuccacgacagccugcagaggc

SEQ ID NO: 4195288 - RNA, 56 nt, Human
gccuuucuagucuuagaagcaguuugauucaguauuuugcuucagaaauagaaagc

SEQ ID NO: 4195289 - RNA, 90 nt, Human
gccuuucucaaaagacccucaaauuauuucugcuggaggagugucuuccaggaaggacuaaugguuuguggaauacacuuugggaaaugc

SEQ ID NO: 4195290 - RNA, 84 nt, Human
gccuuucugcgccugcgcaaagguuucugucaaaacggacagcucuagcugccuaucaggagccagcgugaggcgggggcgggc

SEQ ID NO: 4195291 - RNA, 86 nt, Human
gccuuucuguuuauguaccugaauuaguaaagccagaaugcauucaccugcuuacuuguuuacacaggggagacauuggcagaggc

SEQ ID NO: 4195292 - RNA, 92 nt, Human
gccuuugacauuaaccuguuguuuacugcagugaguguuuguugccucagcauucguuuugaauacagguuuagcuuucucaugacagaggc

SEQ ID NO: 4195293 - RNA, 65 nt, Human
gcuccagauguuucaggggaaacauuucuuauauuuaagaaugaagccacugaagacaaucuugc

SEQ ID NO: 4195294 - RNA, 72 nt, Human
gcuccagccuuccuugugguccuucucauugguacaaaucuccagugcgugggcaggcauggaagccugagu

SEQ ID NO: 4195295 - RNA, 56 nt, Human
gcuccaggagaagcagcaggaagggggcugcccaacccugguguauuuccuggggu

SEQ ID NO: 4195296 - RNA, 83 nt, Human
gcuccaggagggaagagguggugagcccaggccuuuggcaacacuggccaggcccagaggccucuucccacaaguuuggaagc

SEQ ID NO: 4195297 - RNA, 74 nt, Human
gcuccagguagaccuggacaaccacucagccucagggaaaaccauccagaggcugcccugucugucuccugggc

SEQ ID NO: 4195298 - RNA, 64 nt, Human
gcuccagguggcuuauuuguaucuuaucuggugggugccugugaccccuccaucugcuuugagu

SEQ ID NO: 4195299 - RNA, 89 nt, Human
gcuccauaaaacuacuagguggaauucauuggacuuuuccuaaaggguaggcaccaggagaaucacguuagaaguccuauuuguguggc

SEQ ID NO: 4195300 - RNA, 122 nt, Human
gcuccauaugacaggcugguuugacaaacauauugaauaccuacucugugucagggacuguccuaggugcugagaguuuauuaugauaguaagugcacaaucaguauuguugacuauugagu

SEQ ID NO: 4195301 - RNA, 62 nt, Human
gcuccaucccuggagaagcugacccagacagggcucauuggcucuugggggacagauggagu

SEQ ID NO: 4195302 - RNA, 62 nt, Human
gcuccaucugcaaagauugcaaugucccugugaggacaaggaagcaucagagcagaaggggu

SEQ ID NO: 4195303 - RNA, 71 nt, Human
gcuccaugaauucuuuuaaauggcaguaguauuugacuaguauagcaacuccaaagagacuuuguuggagc

SEQ ID NO: 4195304 - RNA, 57 nt, Human
gcuccauguaccuggggucacauuugaccagugggcaggugcuccagggcaaggagu

SEQ ID NO: 4195305 - RNA, 87 nt, Human
gcuccaugucuuccucccucucccugggaugugugguccuuuaagaaaggggccacauugaaggguggguacagaagagaugguagu

SEQ ID NO: 4195306 - RNA, 57 nt, Human
gcuccauucaaguaguuacagugguggcaugcacaauuccuaacugcaugagugggu

SEQ ID NO: 4195307 - RNA, 57 nt, Human
gcucccacaaccuucuugcuccaaguggacaguccagcaaggcagguuucugggagc

SEQ ID NO: 4195308 - RNA, 80 nt, Human
gcucccacagccuucagggcugcccagugugagagcugcugugagucuauauggguagcuugguuucucugauugggagc

SEQ ID NO: 4195309 - RNA, 72 nt, Human
gcucccacaguaaagaaacaacuucgccucaggauaaccuggacugcaguugcuauuacgugguuaaagagu

SEQ ID NO: 4195310 - RNA, 72 nt, Human
gcucccaccaggugagaagccuggcuggccccauagccaugccaugugucgggccugcaguggacccugagc

SEQ ID NO: 4195311 - RNA, 56 nt, Human
gcucccaccgccgcuauggguaggccaugcagcauuccugagggcggggugggcgc

SEQ ID NO: 4195312 - RNA, 56 nt, Human
gcucccacgcaauucuuuucaggggccuuucucuuggggccagagcugcagggagc

SEQ ID NO: 4195313 - RNA, 80 nt, Human
gcucccagcacacgcuuggggugagaccuuggcuggcagcacagggccuggucuuuucugcugcagguugugaagggggc

SEQ ID NO: 4195314 - RNA, 66 nt, Human
gcucccaggagucuggaugaggugucauuuguuuagugccauuccaaaucagaccuucuggguggu

SEQ ID NO: 4195315 - RNA, 57 nt, Human
gcucccaguggucuugaaacagggacacuaaacugaucccucugcuacacugggagc

SEQ ID NO: 4195316 - RNA, 79 nt, Human
gcucccaugugugcgcacccucccggcaucccucccuucggcaggaaugggguucagggaggguugcaagcuugggggc

SEQ ID NO: 4195317 - RNA, 77 nt, Human
gcucccauuccagggccagccauccugcugggaguuugcaucucaagcagcagcaggcccuucgggaggaggggagc

SEQ ID NO: 4195318 - RNA, 56 nt, Human
gcuccccaguaaauaaaugcauuaauuuuaacuuaguacauuuuucaguggggagu

SEQ ID NO: 4195319 - RNA, 82 nt, Human
gcuccccggcacccccucccaggcuccuagaggcccagagggaaucuggggacuuggggccugagagagggaugagggcggc

SEQ ID NO: 4195320 - RNA, 56 nt, Human
gcuccccucccuggacuguggccgcacccagccugggccauccugggaagggcugc

SEQ ID NO: 4195321 - RNA, 74 nt, Human
gcuccccuuaaaacagcaccgaagucgucuaaguuuaggagcuugcgaacucugucugcuguaacaagggaagu

SEQ ID NO: 4195322 - RNA, 79 nt, Human
gcuccccuuuuucucuuaaguccuggauauuaaauugauuaaacugauuauuuuaucccaggaugagaagcaguggagu

SEQ ID NO: 4195323 - RNA, 129 nt, Human
gcucccucauguucuuggcacagcagaaguguucugcacauggucucuacggaggaaagcuggucccccuggcccaggcagcacuuccuccgugagccccugcaguuuccuggugugugcuuggggagc

SEQ ID NO: 4195324 - RNA, 70 nt, Human
gcucccugagccuccagggcagcauggcagugggcagcacgugcggcucccauggcccuggaggcagagc

SEQ ID NO: 4195325 - RNA, 69 nt, Human
gcucccugcccugugaguuggccguuuucuucccaugguggauucaggcauuggcauggcggggugagc

SEQ ID NO: 4195326 - RNA, 60 nt, Human
gcucccuggauguggccagccagccaccugccuacguggacucuggcagcacuagggggc

SEQ ID NO: 4195327 - RNA, 89 nt, Human
gcucccuggcuuugcaccugcuucccugcggcaguccuugagacagcuccucagaaagcccaggagaacagauuaaaagcucccggagc

SEQ ID NO: 4195328 - RNA, 60 nt, Human
gcucccugguauugcugccacucucccugugcucgggaaagcuggaagaagccaguaggc

SEQ ID NO: 4195329 - RNA, 76 nt, Human
gcucccugugaggccagguaccagucaaaucuguagugggucugcuagcagaguuugguaccugggggagggaagc

SEQ ID NO: 4195330 - RNA, 57 nt, Human
gcucccuucccuccuuggccacacaaaaccuucgucaaguuaggcaggguggggagu

SEQ ID NO: 4195331 - RNA, 70 nt, Human
gcucccuuucucaaggucauugaaaauauacaguaguuucagacaucacauggguuugggcaaagggggc

SEQ ID NO: 4195332 - RNA, 99 nt, Human
gcucccuuuuugugauuauauaggcgaggccaugcaugcugaggacugcgaaggacgcuggugucuucugcaucauggucucccugaagcagaguuagu

SEQ ID NO: 4195333 - RNA, 73 nt, Human
gcuccgccccaucaguuccugccccugccccucaugcagacugcccugcuggggccgggccggaggguggagc

SEQ ID NO: 4195334 - RNA, 76 nt, Human
gcuccgcggggccgagcucugcggaaaacgugccggcggcuaccccgacggacgcagcgcgggccccgcagggagc

SEQ ID NO: 4195335 - RNA, 74 nt, Human
gcuccggccuccagccaagcagagagggcccagcaggaaggggcccugagcacugcugcugggggucacagagu

SEQ ID NO: 4195336 - RNA, 82 nt, Human
gcuccgggacggcuguucccugcgugcggccgcgggacugcggacaaagcugcaguguggucgggagcgcggggccgggagc

SEQ ID NO: 4195337 - RNA, 60 nt, Human
gcuccgggccgcgccggcagcccggggacccggcgcaacuugccgggcagccugaggagu

SEQ ID NO: 4195338 - RNA, 69 nt, Human
gcuccuccuucccugggcagguuggggacagacugacagaggaccccagccuuccaugggaauuggagc

SEQ ID NO: 4195339 - RNA, 55 nt, Human
gcuccugaccgugacugccugcucaucccaugccuggcagugucaugguaggagc

SEQ ID NO: 4195340 - RNA, 62 nt, Human
gcuccugauuugauuuugguauaucgaaccagggauauuccaguuauaucaaaucaugaagu

SEQ ID NO: 4195341 - RNA, 56 nt, Human
gcuccuggauguucaagucggccaaggucaaguuggaccggacagccuccuggagu

SEQ ID NO: 4195342 - RNA, 66 nt, Human
gcuccuggguuacuauagccucauugucugucucuccuacuuacagcuccagugcacucagguagc

SEQ ID NO: 4195343 - RNA, 76 nt, Human
gcuccuggucucccaggugauccccucguccugcacuuuggaccagggccucguguucugaguggagaccgccagc

SEQ ID NO: 4195344 - RNA, 78 nt, Human
gcuccuggugaucucuggcucugcuuguacuucauacugaaugaaccacuugcaucuuagagacucaccuaaaagagc

SEQ ID NO: 4195345 - RNA, 57 nt, Human
gcuccuguccuuagccccagagucuugggaaaguucuggauagugaagggcagcagc

SEQ ID NO: 4195346 - RNA, 60 nt, Human
gcuccuuagagguucaaacuucauaauuucagagccugaaauuagauuugauccuagagc

SEQ ID NO: 4195347 - RNA, 78 nt, Human
gcuccuucaauagguucccucucuagcuuuccccaacuguugccuuccagugcagcugugaaagggaaccaagagagc

SEQ ID NO: 4195348 - RNA, 57 nt, Human
gcuccuucuggcucccuuuuggcugggccauucggcuuggugggggugagagagagu

SEQ ID NO: 4195349 - RNA, 96 nt, Human
gcuccuuggagguaugaggccugaggccugaagccugaagugaccagcagguaacugggcaccacagccugaggccaaucagccccaagcaagagc

SEQ ID NO: 4195350 - RNA, 106 nt, Human
gcuccuuuggaaagaauaucugccgcccgaggaugggcucugccuauggaggcaacagugagugucuucagagcccaucaguggcaguggaauuaaugaagaaagc

SEQ ID NO: 4195351 - RNA, 76 nt, Human
gcuccuuuuccuuggguucugauguguuuggcaccaguggaauaucuuaugauuaccucuagggaaaguuuagagu

SEQ ID NO: 4195352 - RNA, 98 nt, Human
gcucgaaaagaaauaugaaaagaugaaaauuuacugugauggcuaguuuucuguaagacauuaauuguauuuuucaaaguuuuguuucuuaguugagc

SEQ ID NO: 4195353 - RNA, 82 nt, Human
gccuuugcuauugugaguagugccgcaauaaacauacgugugcaugugucuuuauagcagcaugauuuauaauccuuugggu

SEQ ID NO: 4195354 - RNA, 57 nt, Human
gccuuugcuggcuuugaagauggugggaggaaccacacuccaaggcuugcaggaggc

SEQ ID NO: 4195355 - RNA, 56 nt, Human
gccuuuggagcaggcuucaaucuucucucccucuggagagaagccugccucaaugc

SEQ ID NO: 4195356 - RNA, 55 nt, Human
gccuuuggcucugucugaccuggguucuaauucuuacucaguacguggccaaggc

SEQ ID NO: 4195357 - RNA, 55 nt, Human
gccuuuguacucugguccaaacuuugccaaaauauggaugcgugagugcaaacgu

SEQ ID NO: 4195358 - RNA, 66 nt, Human
gccuuuguucacuggagaguggaccucugugguuggccuguccaccuacugucagagaccaaaggu

SEQ ID NO: 4195359 - RNA, 57 nt, Human
gccuuuuaaggcagagggagaucccuauggcguuagucuucccaggccuuaaagggc

SEQ ID NO: 4195360 - RNA, 58 nt, Human
gccuuuucaacuaagauucugcaauuauaaauaaaucaauuguuagucuugaaagggu

SEQ ID NO: 4195361 - RNA, 87 nt, Human
gccuuuuccacauucacuacauauauaagguuuuucuccuguaugaguuuucugauguguagugagacugaacuuuguagagaaggc

SEQ ID NO: 4195362 - RNA, 70 nt, Human
gccuuuucuaaucuuugauuguuucucuucccaguuaaggagaaagggauaauuugaagagcgacagggu

SEQ ID NO: 4195363 - RNA, 95 nt, Human
gccuuuuguuugccuggcugcuuuaucggcugcugaaaccugucugcucaguguucucaaagccuuugaaguuuggacugcagcuaacaaggggc

SEQ ID NO: 4195364 - RNA, 66 nt, Human
gccuuuuuggcaggaauauugcagaggugauacuggguucucacucacugcauccugucagguggc

SEQ ID NO: 4195365 - RNA, 73 nt, Human
gcgaaaggucaguguccuugauuccuguuguucaugagcucccagaaccacacacaagguauacgaccaccgc

SEQ ID NO: 4195366 - RNA, 59 nt, Human
gcgaagaggagagacccacagccaggcccguagguagcaguggaaucuuuuguccaugu

SEQ ID NO: 4195367 - RNA, 65 nt, Human
gcgaaggacugcggauuguuguggaagccugugcccaacaggccugugacaccgugucugugugu

SEQ ID NO: 4195368 - RNA, 67 nt, Human
gcgaagguacauauucuaccccuuuuucucugagaaagagaaugugggcacguauguucuuauuugu

SEQ ID NO: 4195369 - RNA, 79 nt, Human
gcgacacugaccaggaagucuccguuaaugaccaaggccagcuugaccugcgacagggacucccugguuagaagguugu

SEQ ID NO: 4195370 - RNA, 70 nt, Human
gcgacaugccucuccuggagaaggcaggggcuuccuggaacuugccccagccuuaucagcggagguuugc

SEQ ID NO: 4195371 - RNA, 97 nt, Human
gcgacuggacuucgcucagcuucagacccugggcugcagcugccuaaugaggugggauggggcccuggguguguaaaguggagggaggggcaguggc

SEQ ID NO: 4195372 - RNA, 78 nt, Human
gcgagcaggcgcgccagcagcggggcuguggccggaggcagacccgggaggcuucgcagcucggcagccgccgcuugc

SEQ ID NO: 4195373 - RNA, 70 nt, Human
gcgagcaggcuagcagggcccagggcagcuugcucggccacaucugcccuggagcugcugucugcugugc

SEQ ID NO: 4195374 - RNA, 63 nt, Human
gcgagcccagcccgggcugcgcuuuccuuccggggaaagagaaaaagaucccggcucggccgc

SEQ ID NO: 4195375 - RNA, 66 nt, Human
gcgagcucaggcccuggcccaccagccaugggaaggcggguccguguggccccagggccuccucgc

SEQ ID NO: 4195376 - RNA, 75 nt, Human
gcgaggaucgcggucccggcccgcgcgcacagagacgccggucccugccaccagcgccgccauccgcauccucgu

SEQ ID NO: 4195377 - RNA, 84 nt, Human
gcgaggcgggcggcugcagacugugucugaaccuggucacguaggcugagugacgagaagcaaagucuguuuuccuaaauucgc

SEQ ID NO: 4195378 - RNA, 62 nt, Human
gcgaggcucaucauaucucaucucugccccagaaggugguucaguggaauguguugaccagc

SEQ ID NO: 4195379 - RNA, 95 nt, Human
gcgaggggucugaauucguugcaagucucugcugagaagggcuggcacauuucuuuccuguguccucuguuaggggauagcgauagacuccucgu

SEQ ID NO: 4195380 - RNA, 112 nt, Human
gcgaggucaggcugccagccagggaaggggcagggagguaagaaaggagagaaaaguucucagcugccugcccugcucccuccccacucccuggcugagggcugcccucugc

SEQ ID NO: 4195381 - RNA, 63 nt, Human
gcgagguuuuugagucauggcuggaggcaacaaggcuuauggcccugacuuggaggccugagc

SEQ ID NO: 4195382 - RNA, 94 nt, Human
gcgaugaucuugucaugcacggauugguaccuggcaggcuuaguuuucucuaggauuucugccaccaacugucacuacauacuuuucaauuugc

SEQ ID NO: 4195383 - RNA, 56 nt, Human
gcgaugcuaagccaccaucugugaggagagcucacagagguccaaacaguauaagc

SEQ ID NO: 4195384 - RNA, 84 nt, Human
gcgauggcagcucaaaggccacggacggcuccggguuggacuucaccacgcacaggcacugcaccgugucucgggcugccgcgc

SEQ ID NO: 4195385 - RNA, 88 nt, Human
gcgaugggggacuaacuggauccuggauaguuucuuucaacgugaacaaguuucaggaugcucagaguagucuacucacaccuauugc

SEQ ID NO: 4195386 - RNA, 86 nt, Human
gcgcacagccggcggcucugauccuggcgcucucccccagcauccccuggggcgggcucuggauggagccugcaggcugagccggc

SEQ ID NO: 4195387 - RNA, 88 nt, Human
gcgcagacggucuguacuuggcugguuuugaguaugugcuggugcggcuccugcacacccucucaccagcacugcagcugccuggagc

SEQ ID NO: 4195388 - RNA, 82 nt, Human
gcgcagguuuguuacauagguaaaugugugccacggugguuugcugcaccugucaacccaucaccuagguauuaagcccagc

SEQ ID NO: 4195389 - RNA, 98 nt, Human
gcgcaguacuugaccccuggcaugcacucaauguguugcagauuugaaauagaauuacaaaacuguaggaauugggugcccuaguggcaacugcuggu

SEQ ID NO: 4195390 - RNA, 70 nt, Human
gcgcaugaggggggcgcccugcagugcaggccucauuccuccccugccucggcccugcccgccugugcgu

SEQ ID NO: 4195391 - RNA, 84 nt, Human
gcgcaugauggagaugcuacuuaugaugcucccuuaagaugggcaggaugcccggggaagaaaucuggguucuucauggugugu

SEQ ID NO: 4195392 - RNA, 68 nt, Human
gcgcauucucuuuccuugcgggcggggugcggggccaaaggcucccacccccuccaaggaggaagcgc

SEQ ID NO: 4195393 - RNA, 71 nt, Human
gcgccaaaguuggaauuuuaauguauguuccagagcguacagaauaguagcuuaaagucaaacugaugcgc

SEQ ID NO: 4195394 - RNA, 86 nt, Human
gcgccaacgccgcagcgccggcgcguccccauggaaacccgcgcgcggggccuccugggaagcgccggccugcgggggcugggcgc

SEQ ID NO: 4195395 - RNA, 84 nt, Human
gcgccagaacagauuuuuauucauuuggaggucgugaauaaaacaguuuuagacuuuggagcagaaagaaauugguuagggggc

SEQ ID NO: 4195396 - RNA, 80 nt, Human
gcgccagccagucccuggggggacggggcacauuggacauguugagaccccucuggccccugugguggauuggugagcgc

SEQ ID NO: 4195397 - RNA, 97 nt, Human
gcgccagcugcaccagacccugggcaggcaagugaauaccuuaggguuuguuccugucagggucacuccugccucuggguuuuggugaaacuggcgu

SEQ ID NO: 4195398 - RNA, 82 nt, Human
gcgccccacgggucaccccuccgcgcgcugccuccugacaucccggcgcucucagcccacugaggggaaacccgggcggugc

SEQ ID NO: 4195399 - RNA, 57 nt, Human
gcgccccaugcuuguaugcaggucacaauucugauggccagcagaagcaaggggagc

SEQ ID NO: 4195400 - RNA, 83 nt, Human
gcgcccccagcuaccccauggccucgcucuacgugggggaccuccaccccgacgugaccgaggcgaugcucuaagcucagcgu

SEQ ID NO: 4195401 - RNA, 98 nt, Human
gcgccgagacuccaggcuugcgugcucuccagccccacguggagccaagcuccgcccggccgccgcugaagggcucccgagcucgggugucucggugc

SEQ ID NO: 4195402 - RNA, 101 nt, Human
gcgccgggagccaaggaugcuguugcucccagggagaggguguccuggcugcggcgcagccccaccucuccugggcagcggcuuagcguggcucuucgugc

SEQ ID NO: 4195403 - RNA, 60 nt, Human
gcgccuggacuucacuuauuugacuuuucuuuugaaaaauuaaauugcuagauccagggc

SEQ ID NO: 4195404 - RNA, 91 nt, Human
gcgccuguguucagcccuggucagccugaccccaaagccuaugcucuagcugcugugcugugggacucaggcuccugugggacacagacgu

SEQ ID NO: 4195405 - RNA, 59 nt, Human
gcgccuguuuguguucuagucuggggacuuggucucguuuggaacaagcagcaguuugc

SEQ ID NO: 4195406 - RNA, 94 nt, Human
gcgccuucuauguaccagacccuggacuggggcugaggcuccaggaucugcccuggaguugucucgagucuagaggagaggacaaaucagacgc

SEQ ID NO: 4195407 - RNA, 84 nt, Human
gcgcgagccucuuuaucuccagguugugccugcguccggagaccacccaaucuuggcgauggcgcucugagauggccucugugc

SEQ ID NO: 4195408 - RNA, 78 nt, Human
gcgcgagccucuuucggcuuuccaguuugucucgguccuuuggaacguggcaaacguggaagccgagagggcucucgc

SEQ ID NO: 4195409 - RNA, 61 nt, Human
gcgcgcacccucugagcuccgcuccgugcgaagcggcggggcugagggcucagggugcggc

SEQ ID NO: 4195410 - RNA, 64 nt, Human
gcgcgcgaggcugggcccugcaggcggcggggggcuggcgccuguguccccgguguccccgcgc

SEQ ID NO: 4195411 - RNA, 63 nt, Human
gcgcgcgucccccuuccccacugcccauggccccgucgggguuggguggaagcgggaggccgc

SEQ ID NO: 4195412 - RNA, 72 nt, Human
gcgcggagcuacaggggggagcauggggcagcccccaaggcgcgcucccugcauuucccacccuuuccacgc

SEQ ID NO: 4195413 - RNA, 55 nt, Human
gcgcggggggaggcgccuccggaucugcuccccggcucccgccucccucccucgc

SEQ ID NO: 4195414 - RNA, 84 nt, Human
gcgcguuccagcccuugaggucuguccaucucaauaaggaagauaaagccuuuauggaacaguccuagagcacggaaugaucgc

SEQ ID NO: 4195415 - RNA, 62 nt, Human
gcgcuauggggagucuuuacccagaaaagaugcaaaauaucuucacagggcuucccaugugc

SEQ ID NO: 4195416 - RNA, 75 nt, Human
gcgcucccugccucccaggccccgcgcuucccgcacagggcagauggcgcaggccuuggauccugguucggaggc

SEQ ID NO: 4195417 - RNA, 77 nt, Human
gcgcucuuuuaugcagauuuguacagugaaggauugaauuucauucaugcucauuuaacaagcuaauggaaguuugc

SEQ ID NO: 4195418 - RNA, 64 nt, Human
gcgcugcccucugugacccggcccaggagagccccucggggggaagggaagagagaggcagcgu

SEQ ID NO: 4195419 - RNA, 69 nt, Human
gcgcugccucugcucuccccacaucccgcacccgagguuuccgccccggcggggagacuagcgcagcgc

SEQ ID NO: 4195420 - RNA, 64 nt, Human
gcgcugugccuggcacccaguguuucuaauaauauaaauugagacauugugacaugcagggugc

SEQ ID NO: 4195421 - RNA, 84 nt, Human
gcgcuguggcaucucuggccagaagcaccuuuggcggccuguugggccccucgcagccucuggcugagacucugccgccggcgc

SEQ ID NO: 4195422 - RNA, 83 nt, Human
gcggaacgccuuggcgcacugggcgcacgcguagggccgcucgcccgugugcacgcgccggugcugggucaggugcgugacgc

SEQ ID NO: 4195423 - RNA, 82 nt, Human
gcggaacuuggccagcuucggcaagcagacuuugcguugcaguguagucagcuugcccagaggccgcgagccaaaggacugu

SEQ ID NO: 4195424 - RNA, 63 nt, Human
gcggaagaaagaaaaucacuccucaaaacacagcagaucugggugugaggucuuuccuuuugu

SEQ ID NO: 4195425 - RNA, 74 nt, Human
gcggacauuccuuucagugcagucggaacuacuguugaucaagcagagaguggcaguuacugaagugucccugc

SEQ ID NO: 4195426 - RNA, 56 nt, Human
gcggagcuucccuuauuauugaguugaagcucaguaauaucuguugaagcuauugc

SEQ ID NO: 4195427 - RNA, 56 nt, Human
gcggagggagauaggccuugcuauaccuguggugucugccaaagcuuccuccuggc

SEQ ID NO: 4195428 - RNA, 75 nt, Human
gcucucagccaguaucugccuacagccugaucugcuacuuucugagccaggcugugguuuagauagagugggagu

SEQ ID NO: 4195429 - RNA, 60 nt, Human
gcucucagccuagacaaggccuuccuaggaggccuaggagcccugcgggaggcagagugc

SEQ ID NO: 4195430 - RNA, 55 nt, Human
gcucuccacugaccacggggcauggucaaauguccaguuggauugcugugagagu

SEQ ID NO: 4195431 - RNA, 56 nt, Human
gcucucccugaaucucgaacuagccugagaccacugcaggcagauauagagagagc

SEQ ID NO: 4195432 - RNA, 70 nt, Human
gcucuccucucccucacaggccacuguaggccuuggaggccuugcucaagcuagugacgggcuaggaugc

SEQ ID NO: 4195433 - RNA, 82 nt, Human
gcucuccugaggacuucuauuggguucugccuagugguaaccgccgaggcuucgcuuacucuguagaucucccgggagcagc

SEQ ID NO: 4195434 - RNA, 83 nt, Human
gcucuccuguaaguucuuggcaauuugaucucaguuugcagaaggcagcuggcauacuuugcuaggaagugcagcuggagagc

SEQ ID NO: 4195435 - RNA, 61 nt, Human
gcugucuccugagacugcagucaccuuggccuacacgguggccccugucucuggggacugc

SEQ ID NO: 4195436 - RNA, 95 nt, Human
gcugucucuggaggaaccauauuuagcucauuuccagugccugaaauaugucuugcaccuguugaacagcugagcuugcccuuugaggagguggc

SEQ ID NO: 4195437 - RNA, 88 nt, Human
gcugugaaggugcauaugcuacacacaugugucucugggggugggugccuaugcuucugggcaaaugugugugacugugccuuugugu

SEQ ID NO: 4195438 - RNA, 85 nt, Human
gcugugaccuuagaaaugauuucaccucuuucuacuucuguuuccccaggugugaaaaggggauaaauuuucuguucuguacagc

SEQ ID NO: 4195439 - RNA, 95 nt, Human
gcugugaggugagccaucuggaaaacacaguguagacugaaaaauaauuauaagccaguuuauuacuuuuuuccaguuaagccuaccaugacagc

SEQ ID NO: 4195440 - RNA, 61 nt, Human
gcugugaguggaguucugugcuaaaaucugcaggugaaacuucaguaauuccagcuccagu

SEQ ID NO: 4195441 - RNA, 91 nt, Human
gcugugaguguaccuggacaccucaguguguggauguuagagaccaguguuuccucauuuggcacaucugagcucagcuuggcaccacagu

SEQ ID NO: 4195442 - RNA, 77 nt, Human
gcugugaguuauaaaugucccugucagagcccgggccgagaggcccugcugcuggcagaggcgccagggcccacagc

SEQ ID NO: 4195443 - RNA, 66 nt, Human
gcugugauugucagucuucaaucucuugucaaaaagcuuucggaaugaacugagaaucuguacagu

SEQ ID NO: 4195444 - RNA, 66 nt, Human
gcugugcacagagcaggggucugugucaguccuggguucaagcccuugcucugcccccugaccagc

SEQ ID NO: 4195445 - RNA, 57 nt, Human
gcugugcacuaccuauacauccaggugaggucgugguguguaguuaggugacacagc

SEQ ID NO: 4195446 - RNA, 108 nt, Human
gcugugcccaagacuuaacuccccaggcccagcuuuaucaagucugagcugaguuuuccuuacuaauuugaaacaggcagccagggaaggaaagucaugaaauaaagc

SEQ ID NO: 4195447 - RNA, 58 nt, Human
gcugugcccucagggaccaucugcagagguaguguggccaauuaugggcauucaaagc

SEQ ID NO: 4195448 - RNA, 57 nt, Human
gcugugcucacauguuucaaggauaaggauaauuccauugagaaucugggcuacagc

SEQ ID NO: 4195449 - RNA, 55 nt, Human
gcuguggaauggcugccagcucccuuccugggagaggcugggugggguccacagc

SEQ ID NO: 4195450 - RNA, 81 nt, Human
gcuguggagcgugcugccugccagcuucugggugcuucagagauuugccaggcccaggagggggcaggaggcgcccggagc

SEQ ID NO: 4195451 - RNA, 81 nt, Human
gcuguggauuuuuucauaguaauggugcauguagcauccacugauacacaugguuucuaugaaaggauaacuucuaccagc

SEQ ID NO: 4195452 - RNA, 57 nt, Human
gcuguggcugaccaccagggggcagcugugagccccauggccaggcacgcgcauagc

SEQ ID NO: 4195453 - RNA, 82 nt, Human
gcuguggcugaucugacaggaggcagagcucaggugguaauguuggcuugcccacugcucuccuacugcaaugcagcccagu

SEQ ID NO: 4195454 - RNA, 61 nt, Human
gcuguggcugcugguacucugggaaccggcugcugguacucugagaaccgguagucuaggc

SEQ ID NO: 4195455 - RNA, 59 nt, Human
gcuguggcuguccaaggccuucacgccucugcacuccaggaggccucuggacuggcagc

SEQ ID NO: 4195456 - RNA, 63 nt, Human
gcugugggcuucaggcugaauuccuccuagauaggaaagcugucuauggccuucugucacagu

SEQ ID NO: 4195457 - RNA, 81 nt, Human
gcugugguguguauuuuaaggccuugagggaaauuuuaaaaacuuaaaacugagauuuccugcacugccuuugaucacagc

SEQ ID NO: 4195458 - RNA, 57 nt, Human
gcuguguacauugucacucaucaaguuuacgaaagagcuaggggacaugugcaaggc

SEQ ID NO: 4195459 - RNA, 56 nt, Human
gcuguguaccuacuaacugcuuuacccuggucuucuggcaggauagguauaucagc

SEQ ID NO: 4195460 - RNA, 106 nt, Human
gcuguguaggugguuuuagagauucugauggcuuacagacaguuaggaugccaagauccaaacucaaguuacaggccagauagguucugcaagacuucugcacagu

SEQ ID NO: 4195461 - RNA, 56 nt, Human
gcuguguaugaugcaggcaccugggccgucacucagcuggcugucucuuacacggu

SEQ ID NO: 4195462 - RNA, 79 nt, Human
gcuguguccgucucuuuugaacucacuggaugaguuaacacucagccaguuaaggcuuagacaggcucggacuuacagc

SEQ ID NO: 4195463 - RNA, 65 nt, Human
gcuguguccuaugaaagaggguuagguauccuggcagauacuuaacucucaaacauugguacagu

SEQ ID NO: 4195464 - RNA, 56 nt, Human
gcugugucggacuaugguucacagugugggagacacugcuguggcccccgacaugc

SEQ ID NO: 4195465 - RNA, 66 nt, Human
gcugugucucauuuccuccugcugugcccgugauguccuggcccagugugacgaggugaggcaggc

SEQ ID NO: 4195466 - RNA, 65 nt, Human
gcugugugcauuuuguucucauugccucgggagaggcagcaacucggagagaagagaaugucagc

SEQ ID NO: 4195467 - RNA, 58 nt, Human
gcugugugcucuggucuuucuuagcauaauggaguggaaaaagcuggggcaugcaugc

SEQ ID NO: 4195468 - RNA, 79 nt, Human
gcugugugggugaccaguguuuuccaguuugcccagaacuuucccaguuuugaggcuaaaaauucugcauccucacagc

SEQ ID NO: 4195469 - RNA, 96 nt, Human
gcugugugucuguaaaaugacugacagugguacuguaauuaaaaaauauauauuuauguaaauauagugacacuuauagucuggcggauggauugc

SEQ ID NO: 4195470 - RNA, 61 nt, Human
gcuguguguuuucagucugcauugucacccauaaugcaguacugauauaaacaaacacagc

SEQ ID NO: 4195471 - RNA, 93 nt, Human
gcuguuaaguauuaaagauucugaaagggguggggcuggcgucacguuuuucauugaucccugccccagcucugucagugucuagcacacagu

SEQ ID NO: 4195472 - RNA, 77 nt, Human
gcuguuagaaaaacaugcuuuuguuauagugugguuuucuuaaaaagagaauuguaauaauaauagcauuuggcagu

SEQ ID NO: 4195473 - RNA, 81 nt, Human
gcuguuagcauugguagguuaaauuuacguuccccagaucaaaaucuggagaaacaacacuugaugccuuugacuaauggu

SEQ ID NO: 4195474 - RNA, 81 nt, Human
gcuguuauacuucaaguaggucugauucaaccaacaauaaaaaugagaagguuaaguuuaaauguacaugaagcuugcagc

SEQ ID NO: 4195475 - RNA, 91 nt, Human
gcuguuauguagaugaaguguaacuuguaaugaguguuucuggaaaacaaaacauucaaaacccaguucagucaccugcagaacuuucagc

SEQ ID NO: 4195476 - RNA, 70 nt, Human
gcuguuauuagcugcuuucuuguugcaucuuaauuauuagguugaaaagaaagggcagacuuuuauaagc

SEQ ID NO: 4195477 - RNA, 63 nt, Human
gcuguuauugcauaaaaucagguuagagaugauggucacucugacuaaagugauagugauagu

SEQ ID NO: 4195478 - RNA, 75 nt, Human
gcuguucagcaauagagggugaauucagggcccauuuuucugugccugacugcagggccugacacccuugccagc

SEQ ID NO: 4195479 - RNA, 82 nt, Human
gcuguucauggguuuaauucagaggcuguaugacuagaucuuuccuaccuauaagaggucgcagcacuuaccugauagcagc

SEQ ID NO: 4195480 - RNA, 91 nt, Human
gcuguucauuuuuacucuaccucguuuuggaaucacuaauguggccaauuuauagccaaaaaucaguaucguagagugagcaaugaauggc

SEQ ID NO: 4195481 - RNA, 62 nt, Human
gcuguugcaaucaaggccauggcaaaauaacuggcucccaagguggcagugguggcagcagu

SEQ ID NO: 4195482 - RNA, 63 nt, Human
gcuguugccauuuuaugguuauuaaggcugcuagccuaggaacuaguagauguguaaacaugc

SEQ ID NO: 4195483 - RNA, 77 nt, Human
gcuguugcugcccccucuugugggcucaggucagcacagguaaucugcaggacuccaggggaggggaggaagacagc

SEQ ID NO: 4195484 - RNA, 62 nt, Human
gcuguugcugggaacgcaugucacaacaugauuuaauuauggcaaagcauucuuauaacagu

SEQ ID NO: 4195485 - RNA, 65 nt, Human
gcuguuggaagaggcaaugguguacugauacauuucagcugacauacuacagucucuuuaucagu

SEQ ID NO: 4195486 - RNA, 69 nt, Human
gcuguugucaucgccgagguccugcuccaaguucuccuugcaguuuagguccucugugcuggugaaggc

SEQ ID NO: 4195487 - RNA, 66 nt, Human
gcuguugucccuaggaguccuguguaggugcuguugggccuacagaggccucguagguacaacagc

SEQ ID NO: 4195488 - RNA, 66 nt, Human
gcuguuuccccaaccccacaaguaugucacaagcaguuuguuuauuugggggcugggggacauggu

SEQ ID NO: 4195489 - RNA, 64 nt, Human
gcuguuucccuccaggggguggauuucuagaucauucuucaggccccucggaggcgaugagagc

SEQ ID NO: 4195490 - RNA, 66 nt, Human
gcuguuucucccagucuccugagacagacugaagaggcccuuucucucugacugggagcugacagu

SEQ ID NO: 4195491 - RNA, 60 nt, Human
gcuguuucugaguagcuaggcuggccaguagcaagacuggaguuccugguucuuaacagc

SEQ ID NO: 4195492 - RNA, 85 nt, Human
gcuguuucuuacuaaaguagaggcauugaucagguaaucaguagaguugaucagauccauaaugaccuguggagugagaaacagu

SEQ ID NO: 4195493 - RNA, 69 nt, Human
gcuguuugaccuuagaacgugacacaagaagagcaauacuggcuccuccaauuucuuaaggagggcagc

SEQ ID NO: 4195494 - RNA, 64 nt, Human
gcuguuuggccagccugacugaaccugucaacagcuagaaagugaggucagcugggcuagaggc

SEQ ID NO: 4195495 - RNA, 73 nt, Human
gcuguuugguggcuguugcagaacugagggagggaugauuuguuugauuuacuauaagcagcacaaaggcagu

SEQ ID NO: 4195496 - RNA, 114 nt, Human
gcuguuuuaugugcuguauugauauuagaguauuuguuuggcuucaguggguacuuaauuauuuguuucuucuugacagugugcuagaauuaauucauagcauuaugaagcugc

SEQ ID NO: 4195497 - RNA, 60 nt, Human
gcuguuuugaagauguggucucagauccucagcccaccauucaaggucuucacagucagc

SEQ ID NO: 4195498 - RNA, 56 nt, Human
gcuguuuugcuagucccaccucaugaaaacuaccauaaggaaaggaucaaaauagc

SEQ ID NO: 4195499 - RNA, 90 nt, Human
gcuuaaaguucucccuccaggcccagggccaagagcgccucacaaagggcugcugccuugaacuuggccuggggaaaugagacccugagc

SEQ ID NO: 4195500 - RNA, 70 nt, Human
gcuuaaaucccaaugcuagaccugguggcuagaccuugauugccaccgggucuagcauugggauuuaagc

SEQ ID NO: 4195501 - RNA, 77 nt, Human
gcuuaaauguauucucuuuauaagauagaaaggaauagaacauacgcucccuauuuuacaaaugggaaugcugaggc

SEQ ID NO: 4195502 - RNA, 70 nt, Human
gcuuaagcgagcacauugagugaagaauagcaucuagcaguuugcucauucaaugugcauugccgauagc

SEQ ID NO: 4195503 - RNA, 77 nt, Human
gcuuaauauuauguagguuaggugguugucauccuaguugggagaaaacaaugaaaaaauuuacugugguguuaggc

SEQ ID NO: 4195504 - RNA, 61 nt, Human
gcccugccugacagagaagguucagccucacucccgcucaccacucacucaggcaagucgc

SEQ ID NO: 4195505 - RNA, 98 nt, Human
gcccugcucugaggaaggaggccaugcccuggucugagggaggaggcauaacccuggucugggggaggaggcauggccccuggucugagggaagaggc

SEQ ID NO: 4195506 - RNA, 65 nt, Human
gcccugcucugcagcuuggacucccucucaggacagugacagugagaugaggcagggccaggagc

SEQ ID NO: 4195507 - RNA, 97 nt, Human
gcccugcugcugacaauguugaagcagggucuggacaaccccuuguugagggcauuugguggccagaucuucuuuucagugucuucagaccuugggc

SEQ ID NO: 4195508 - RNA, 83 nt, Human
gcccugcuugucucagcugaugccauguggaacagugcuggccuggcagugcccuguggcuucagcaauccggcaggcaaggc

SEQ ID NO: 4195509 - RNA, 89 nt, Human
gcccuggagaagugguguccaggacccuauucucacucugaccugugguuucaguggacuuggguuuugaaggaguccuucucaagggc

SEQ ID NO: 4195510 - RNA, 55 nt, Human
gcccuggccauagcucuuguauccaugguugaacaguuggacacauggccugggu

SEQ ID NO: 4195511 - RNA, 63 nt, Human
gcccuggccuccuggaacaggcagcucuuuuucaccccccugcuugcuccugguccccagggc

SEQ ID NO: 4195512 - RNA, 68 nt, Human
gcccuggccugugaaucugagagcccuggagcccuggccugugagccugagauucccggagccguggc

SEQ ID NO: 4195513 - RNA, 57 nt, Human
gcccuggcgccgagcucuggggaaggcagaggcaugguucucaggcugggcggcugc

SEQ ID NO: 4195514 - RNA, 61 nt, Human
gcccuggcuccagcugccuguccuuguuuaagaugauggguugagguuggacccacugggc

SEQ ID NO: 4195515 - RNA, 70 nt, Human
gcccuggggugaucucuggcuuuccgaucuuugaagcccauaaaaagaggucccuccgguuaucuuuggc

SEQ ID NO: 4195516 - RNA, 95 nt, Human
gcccuggguuugcgggaagugggcuccagccaggauggcccagggaugggcaguccacagggccuuucuggugugggucuggugagccgaggggc

SEQ ID NO: 4195517 - RNA, 69 nt, Human
gcccugguuggcugagcagagucacucuuggucacagagaguggcccuguggggucagaugagaggggc

SEQ ID NO: 4195518 - RNA, 74 nt, Human
gcccuguccuccagauuaugcucucaguuauaaaagacugaggaggcuaauuugaggauuuccugcauaggggc

SEQ ID NO: 4195519 - RNA, 64 nt, Human
gcccuguggcaccaauacauuuuucuaaaguguagagaggugaauguggaugccacggucuggu

SEQ ID NO: 4195520 - RNA, 89 nt, Human
gcccuguggucuuuacagucucuguggcaacaauucacuaugccaucauagugggaaaugagcuacagauaaucuguaaccaaaagggc

SEQ ID NO: 4195521 - RNA, 84 nt, Human
gcccuuauaggcagagagggcagggcgguaaguccugaaaaaaagauucuaggagcccccacgugccugguucucugcgagggc

SEQ ID NO: 4195522 - RNA, 64 nt, Human
gcccuuaugagccagccucagaagucacgcagccuuacugcugccacacucugcugcucagggc

SEQ ID NO: 4195523 - RNA, 61 nt, Human
gcccuuauugugucuugguuuaucuuuugucaccuacuaaagagcauggcaagaaaagggu

SEQ ID NO: 4195524 - RNA, 55 nt, Human
gcccuucugguauaaaaaccgagccaagacucaguuaucaaauacuaugaagggu

SEQ ID NO: 4195525 - RNA, 72 nt, Human
gcccuugauguccugcaacugaaggagaaggauguccuuaaauuccuugcagcaggaacucauuuagguggc

SEQ ID NO: 4195526 - RNA, 56 nt, Human
gcccuugcccauggcucuuccuccauucuaccccagaaagcagcccuggcaagagc

SEQ ID NO: 4195527 - RNA, 56 nt, Human
gcccuuggaacagccuccugcucuggggcagaaucuggggugagguuguucugggc

SEQ ID NO: 4195528 - RNA, 71 nt, Human
gcccuuggcaaauucuccuuuaucuucugucucuuauagauaaaccaucaggcagauuugucaacagaggc

SEQ ID NO: 4195529 - RNA, 100 nt, Human
gcccuuggcacccacguaggcagggggcuguggcuguccaguccguggacuugcacuggauugggccauugccucuucuguucucgauggcgcuaggcgc

SEQ ID NO: 4195530 - RNA, 90 nt, Human
gcccuuggcaugcagugcaggggcugggccaggguagugacccuucacaccugugagucucggcuugccugauuauugggugccagcugu

SEQ ID NO: 4195531 - RNA, 59 nt, Human
gcccuugggagguuccacuggggcaaaagccagaguuuuguggaauguuccaaggaggc

SEQ ID NO: 4195532 - RNA, 62 nt, Human
gcccuuuggcaagucaggaaguugacauugaucuauucaucaacaccccuuugcuugcuggc

SEQ ID NO: 4195533 - RNA, 57 nt, Human
gcccuuugugauuuuagccaucauccguguaauggcuaaaauucagaagaaaacggc

SEQ ID NO: 4195534 - RNA, 69 nt, Human
gcccuuuuggguggaagcuguuauggcuggaccuuaaaugaucuucguagaguugucgcccacccuggc

SEQ ID NO: 4195535 - RNA, 89 nt, Human
gcccuuuugguuacagauuaucuguagcucauuucccacuaugauggcauagugaauuguugccacagagacuguaaagaccacagggc

SEQ ID NO: 4195536 - RNA, 57 nt, Human
gccgaagcugccgucugguccuguaacuugaugcccgugacaguuggcagcugcggc

SEQ ID NO: 4195537 - RNA, 58 nt, Human
gccgaaguucugggauuuccacagugccaaguuacuguaagagccuccggacugaggc

SEQ ID NO: 4195538 - RNA, 59 nt, Human
gccgaauucccaggucaggcugcagcagggcugguuccugaggccucuccugggcuggc

SEQ ID NO: 4195539 - RNA, 59 nt, Human
gccgaauuugaacuaagcucuacuucacucaaagucaguguuugguuucagaauugugu

SEQ ID NO: 4195540 - RNA, 74 nt, Human
gccgagaaccauuugcaguuacugagacaugcugggauaccucucaggguuuuagaagcagcaaagguaucugc

SEQ ID NO: 4195541 - RNA, 64 nt, Human
gccgagcacagugcagcugccuuaucagauggggcacacaggcuugcacagugagcaucucggc

SEQ ID NO: 4195542 - RNA, 123 nt, Human
gccgaugggcuggcgcuauggcucacgugggcgcaggaagggaagcuggauggaauacucgggaagcaaauuuucugugacaguucuggcgcccaugagcagaguugcucaguauccuucggc

SEQ ID NO: 4195543 - RNA, 81 nt, Human
gccgauguaagugacagagccaggucuugaacucaggccacccugacuccaaaguuugggcucuucccuaccaauccaggc

SEQ ID NO: 4195544 - RNA, 66 nt, Human
gccgcacuguuucacuacugggcagugaaaucagauuguacacuaguggcagcaguauuuauaggc

SEQ ID NO: 4195545 - RNA, 89 nt, Human
gccgcacuuguagggccgcucuccgguguggaucuucuggugcucuauaagcgaggacacguggcugaaggcggccccgcauugcaggc

SEQ ID NO: 4195546 - RNA, 68 nt, Human
gccgccagggccacugcaugagguucacacacccgcugauugugauucugccccuuggcucuggcggc

SEQ ID NO: 4195547 - RNA, 89 nt, Human
gccgccauggacccagggcugagcugugaccaugagggcuaucccgacgagcugccguggacccagggcugagccgugaccaugagggc

SEQ ID NO: 4195548 - RNA, 76 nt, Human
gccgcgaccgcucccucuguccgaggccggcuccgucgcgucgcggagcagcucgggcuacagagggggccgcggc

SEQ ID NO: 4195549 - RNA, 56 nt, Human
gccgcggcuccgcgcucccgcuggaugggguugcgcucgccagggaggggccgcgc

SEQ ID NO: 4195550 - RNA, 71 nt, Human
gccgcugccaccuccugcccugcccacuggggguccaggccucaggagguccgcccgggaggggcagaggc

SEQ ID NO: 4195551 - RNA, 82 nt, Human
gccgcugcuauuuccucagagucuaguaaauaauaagcaaucaauaccugcuguugacuuaccucuugagugaauucagugc

SEQ ID NO: 4195552 - RNA, 106 nt, Human
gccgcugggugcgcguggccgccagguccucguccaccuuggugcgcacaaaguagaacuucuugcccuggcacaggaucucagcggccaggcgggucucgacggc

SEQ ID NO: 4195553 - RNA, 89 nt, Human
gccgcuguguaacugugagccccuucugcagucagguuuccaggaugccuguggacagggcugugggaggagcagcaggccaccagggc

SEQ ID NO: 4195554 - RNA, 60 nt, Human
gccggagccgcgcgcgaugauucauugccccaauuaggggcucucugcagcgcgcccggc

SEQ ID NO: 4195555 - RNA, 118 nt, Human
gccggcagagauccugguggaggcagaucgcuuuugcgccaguagcuggugguggcuuuugauuuggaagcuuccucgcugggcagaggcagaccagcucuacuguagggcugcaggc

SEQ ID NO: 4195556 - RNA, 129 nt, Human
gccggcugggcgcugggggcgggcuggggacugcggagcccuuugcagcuuccaggagcuccugcuuccaggagccacacaggggcgggcagccgguucccgcccuucucaggugcgcacagccuuggc

SEQ ID NO: 4195557 - RNA, 58 nt, Human
gccgggaccuguuuuucaaaaggcauaauguuuuuugcuguggauggcagguccuugc

SEQ ID NO: 4195558 - RNA, 67 nt, Human
gccgggagaggcggcgcaggggcccaguccaccgagcgccgggcggcccuugccugcacuccucggc

SEQ ID NO: 4195559 - RNA, 91 nt, Human
gccgggauggucucgaucuccugaccucgugauccgccugcuuuggccucccaaagugcugggauuacaggcgugagucaccgcacccggu

SEQ ID NO: 4195560 - RNA, 105 nt, Human
gccgggcauaguggcacaugcuuguaaucucagcuacucaggaaagugaggcaugagaaucauuugaaccuggguggcagagguugcagugagccgagauccggc

SEQ ID NO: 4195561 - RNA, 57 nt, Human
gccgggcucagacaucccuccuggagcuuguauuuccagguccccucugggucccgc

SEQ ID NO: 4195562 - RNA, 67 nt, Human
gccgggcucuccagaauaugccgccgugggcuucggccuggcagcagggccccuggaggagccuggc

SEQ ID NO: 4195563 - RNA, 75 nt, Human
gccgggcuggggagcuggccgccuaugugcaggagaaccuggaggccgcacagcuggcuggcgagcuggcccggc

SEQ ID NO: 4195564 - RNA, 83 nt, Human
gccgggugcugcagcagugcgggcagcuucagaagcucaucggcaucucucuuggcagccugcgcgggcugcccaccaagugc

SEQ ID NO: 4195565 - RNA, 90 nt, Human
gccguaacugucacagacuggguggcucaagcagcagaacuuuaauuuuucacugugcuggaggccagaagucugagaucaagauguggc

SEQ ID NO: 4195566 - RNA, 84 nt, Human
gcucucuaccuccaugagcccucuucccauuuuauuccucacuugaaauagucugagauauggggcauugggugguaagggagc

SEQ ID NO: 4195567 - RNA, 75 nt, Human
gcucucugacucacuuagcagguuaauaucaagcauguuaauagcuuugccauugcucagugaacagauucuagc

SEQ ID NO: 4195568 - RNA, 56 nt, Human
gcucucugcaagucagcagccuccagaaccuggcaaugaguugaaugcaugagagc

SEQ ID NO: 4195569 - RNA, 57 nt, Human
gcucucugcuguauccuuaggcuuuggaacaguccccagcccauaguagcacgaggc

SEQ ID NO: 4195570 - RNA, 114 nt, Human
gcucucuggaccaggccuuguguuaaguccugaagacacagaaaaggcuaaaacagccccuggucuuaaggacucacagaucaugaggaggcgauagauacuggaauagaaggc

SEQ ID NO: 4195571 - RNA, 109 nt, Human
gcucucuggcagucaaggcgggaggacugaaggacaaucugguuccaacaccacaguguggcugccguuggcucuucaggccuccucaccucccacccucugccuuugc

SEQ ID NO: 4195572 - RNA, 72 nt, Human
gcucucuggcuccacuaguuuaauaccuuccuuucuucuuuguugaagaagggauggacgagagccagaggc

SEQ ID NO: 4195573 - RNA, 75 nt, Human
gcucucuuaggacuuuuucucaguaagcccugauaccuugaugugagaaggccaagaagaagccuauagagaugc

SEQ ID NO: 4195574 - RNA, 93 nt, Human
gcucugaaacgugaucuguacauuuauuuuugcagcauauugagguauucauuguggcuuaauaaaugacagauuuuuaugacuuuuaugagu

SEQ ID NO: 4195575 - RNA, 70 nt, Human
gcucugaaccugugucuuggccacuaggagugccacaccuggcacugcccccugcccaggacuucacagc

SEQ ID NO: 4195576 - RNA, 57 nt, Human
gcucugaugccagccgcuuccucuuggucuagagccaaggaagcccugggucagagc

SEQ ID NO: 4195577 - RNA, 64 nt, Human
gcucugcagauguguucugaagcucaggucacagauggagcugugagggacacauugcuagggc

SEQ ID NO: 4195578 - RNA, 79 nt, Human
gcuugauauauuuuuaaaauuggucuuagcuguuauacagggauaauccauaauugagaccuuaaaagguaugucaugu

SEQ ID NO: 4195579 - RNA, 124 nt, Human
gcuugaucgucacuguccuuucuaggcugagguugaugccaggggaagcugcuguggcacugggcuucuggugucagcguaggagacagggaucuaggacaacagggaccagguggcgacaugc

SEQ ID NO: 4195580 - RNA, 80 nt, Human
gcuugauugagagaaacuuguuuuaaguagguagcgugaccagccacaguugaggacuuaaacaaaacucuuuguuaggu

SEQ ID NO: 4195581 - RNA, 103 nt, Human
gcuugcaaaccaggcuggagauggcaccuuccccagagcucaggaauucugggugaggauugaguguggggaaugucaugagauuuagccugcuccuguaggc

SEQ ID NO: 4195582 - RNA, 77 nt, Human
gcuugcagagcagagaaagucuauucaggugaaaaaugguucauuuuugacucauugauuuucucugcucauugagu

SEQ ID NO: 4195583 - RNA, 129 nt, Human
gcuugcauugcuacagugaguuuuaaaaggcuugauugcuacuuucaguuugguucauugucuuagcugagcacuuugacacuuggaagcuuggcaacauuaccuggaccaucguggcugugcagaggc

SEQ ID NO: 4195584 - RNA, 89 nt, Human
gcuugcauuuguguguguggaguugacagaaaccaccacauaggcauguguauacuucuuccucacacucucacccauacaagcauagc

SEQ ID NO: 4195585 - RNA, 95 nt, Human
gcuugccaaaugccuuuggaaaccaggcuuugagacgccuuugugacucuuguuugcauguuuuuuggcuaugauaucgaggcauuugguucugc

SEQ ID NO: 4195586 - RNA, 73 nt, Human
gcuugccacuggcuggccaugcgggcgggcaggcuagacauucuugccgcgcaggcgcaguucguggcgucgc

SEQ ID NO: 4195587 - RNA, 55 nt, Human
gcuugccggagcaaacgugcuugaacgugucuugguucuugcagccccagcaggc

SEQ ID NO: 4195588 - RNA, 59 nt, Human
gcuugcucuggcucaaaccaccggcucuucugaccauggugggucugaccauggugggu

SEQ ID NO: 4195589 - RNA, 58 nt, Human
gcuugcugcaaccaacccugacauuucagguuggaaagaaggcuugguugcagcaagc

SEQ ID NO: 4195590 - RNA, 64 nt, Human
gcuugcugucaagcguaggcuuuuauugcuuuguuuuggucagugcaugcuugacuuagcaagc

SEQ ID NO: 4195591 - RNA, 89 nt, Human
gcuugcugucuacuguacuuauuuuaugucagcacaguguauaauugauugcacauacaugaaauauguagcacacuggacuuccaagc

SEQ ID NO: 4195592 - RNA, 64 nt, Human
gcuugcugugcccccugccugccccaguacgagcgggcccuggacguggcggcagagcccaagc

SEQ ID NO: 4195593 - RNA, 55 nt, Human
gcuugcuuaaccaaaacuagucaucaguuuucugaacugccuugguucaguaggu

SEQ ID NO: 4195594 - RNA, 60 nt, Human
gcuuggaaaauaaaaguucaggacucuguuuuuauagcuacagucuuguauuuuucaagc

SEQ ID NO: 4195595 - RNA, 72 nt, Human
gcuuggaaggcugugcaguguuugcauucuaagggcugcggagacagcuggagaucugcucagcccaccagc

SEQ ID NO: 4195596 - RNA, 76 nt, Human
gcuuggaugugcgauggaagcagacagguaauuccuuccuugggggcaaugaccuacugcuuucugcauaacgugc

SEQ ID NO: 4195597 - RNA, 74 nt, Human
gcuuggcagguaugagugagaaaugaaauuggcuuaagccacugauaucauuuguuacagccacauaccugagc

SEQ ID NO: 4195598 - RNA, 56 nt, Human
gcuuggccagcagccgggaugcccacuucugcuugaucucgggcuucucgcccagc

SEQ ID NO: 4195599 - RNA, 71 nt, Human
gcuuggcuccuucuggaggccauagggaaggaucgguuuccuggcuuuuccagcuucuagaggcagccugc

SEQ ID NO: 4195600 - RNA, 66 nt, Human
gcuugggcaggggaaacagcugcccaccagguuuuccuggacagcagugcccaccugccuacuagc

SEQ ID NO: 4195601 - RNA, 67 nt, Human
gcuugggcuggccggacaggccagaggcucugggcccggggccugcuggacauuggccggccucagc

SEQ ID NO: 4195602 - RNA, 72 nt, Human
gcuuggggaauggccauuccagauugcucugaagugugugucuggacaggacuauuucuaacaugaccaagc

SEQ ID NO: 4195603 - RNA, 77 nt, Human
gcuuggggaugcugaagugaagugaucuugaacagaugucagcaucaggaccuguaccucagcaucuaacaccaagc

SEQ ID NO: 4195604 - RNA, 75 nt, Human
gcuugguucaaaacauggaaggguguucugauaaguauauacauaagagcacacaccuuuccuuuugccucaagc

SEQ ID NO: 4195605 - RNA, 67 nt, Human
gcuuguaaauuggaaaucaaucaagacagcuuuuauuuuaguuccugauggcuguccaauuacaagc

SEQ ID NO: 4195606 - RNA, 75 nt, Human
gcuuguacguggauuggggacaauguuuucuagccucuccaagggcugaguuccugccucacucuauucguaagc

SEQ ID NO: 4195607 - RNA, 74 nt, Human
gcuuguacugugguaugacgcauauuucuggaguuuggcaaaccccagaaauaugugccaugccuuagugaagu

SEQ ID NO: 4195608 - RNA, 56 nt, Human
gcuuguaggaggcaguggggaguggcugcccaaacggccccacuguccccacaggc

SEQ ID NO: 4195609 - RNA, 69 nt, Human
gcuuguccauuucuuuaucucuugucaccauaugcaugauguacuaaccaggaggaaaaaaugacgagc

SEQ ID NO: 4195610 - RNA, 65 nt, Human
gcuuguuaaacacagugugugcagucggacggagucccggccgugauucaugcacuguacacagc

SEQ ID NO: 4195611 - RNA, 70 nt, Human
gcuuguucuaggagaugagcugugaaaagcauaaucaauuauguuacuucuuauuucuuacauuucaagu

SEQ ID NO: 4195612 - RNA, 58 nt, Human
gcuuguucucacuacugcauggggauagggaguacucagaccagugggauaaauaggu

SEQ ID NO: 4195613 - RNA, 92 nt, Human
gcuuguugagcagguacaaugcacuagggacugugugagggacuugauguauauuagcucuuuuaauccuuaggacagcccugugaacaggc

SEQ ID NO: 4195614 - RNA, 70 nt, Human
gcuuguugauguggacgucuggaacuugaauagaagacauuucuuauuucagaugcauccauuagcaggu

SEQ ID NO: 4195615 - RNA, 93 nt, Human
gcuuguugcaguggcacuucuugggccucaccccagacccaaagaauuggaaucucuggggaugaggaccuagauggugcaguuuuaacaagc

SEQ ID NO: 4195616 - RNA, 95 nt, Human
gcuuguuuuaaguuaggggugauaacagauauaggcagaacuuugcaauguaaauguuuagucuuauuugggcacugcugaauuuguuuccgagc

SEQ ID NO: 4195617 - RNA, 62 nt, Human
gcuuguuuucaucuuuaucugagacaugugaugaacugucugaaggcagguggagaacaggu

SEQ ID NO: 4195618 - RNA, 129 nt, Human
gcuuuaaauuaaaaccugaaaauaaauucccaucaguuaagaagagcuaggcaucuccuugugaauuguccauagcuguucacaagcugauugucuuucuuuucugcagggauuucagggaaaauaagc

SEQ ID NO: 4195619 - RNA, 64 nt, Human
gcuuuaagacugauguccagucccauggggaacagaagccacauggggccgauauuagcucagc

SEQ ID NO: 4195620 - RNA, 82 nt, Human
gcuuuaagcugucuauauauugcuugaauaaucugguaaaauaucuuacauauuauucauguagauucaguauaguauuugc

SEQ ID NO: 4195621 - RNA, 85 nt, Human
gcuuuaauaaagagccucuguguuucagccucaugaauauguuuaaauuucaaaggaccuggaucacagagaucugcaccagagc

SEQ ID NO: 4195622 - RNA, 87 nt, Human
gcuuuacauaggauuucucuuuuugcaacuucauuguggauuuuaacaggaagggagaagaaagaaauucuauugcacacguggagc

SEQ ID NO: 4195623 - RNA, 60 nt, Human
gcuuuaccauacaucaaaauauuuuauacauuucuaggaauaaaaacugugugguaaagc

SEQ ID NO: 4195624 - RNA, 56 nt, Human
gcucagggaaugagaagauguugauuucacuuauuuucuucuuugaucuucugggc

SEQ ID NO: 4195625 - RNA, 55 nt, Human
gcucagggagagagggcagccgcccagcucgggccccaugccaucccccuugggc

SEQ ID NO: 4195626 - RNA, 87 nt, Human
gcucagggguagucgguugggugggggcccgcugaacugacaagcggcauuucagcuccuuucuuccaccagucggaaccccagagc

SEQ ID NO: 4195627 - RNA, 55 nt, Human
gcucagguagaugggguuguccaccacccgcuggccagccugcaucaucugcagc

SEQ ID NO: 4195628 - RNA, 115 nt, Human
gcucagucuucugagucucaaguuccgugucuagcaguugaaaguaaugcggugcugacggcacugagguuuuuaguguuaaauggaugagcacugggaaguguuuuugcugagu

SEQ ID NO: 4195629 - RNA, 69 nt, Human
gcucaguguuucugguagaaaaggcaauuuucaagacugaaauagcaauuucuuagccaucacuggagc

SEQ ID NO: 4195630 - RNA, 81 nt, Human
gcucaguguuucuguggauggcaagguggugcuuuugguuuuguccacagagucuuccuucucuucugcugaauucugagu

SEQ ID NO: 4195631 - RNA, 57 nt, Human
gcucauaccaacagcuuuccucacccagguuccuggcuggcccuguaggaugugagu

SEQ ID NO: 4195632 - RNA, 65 nt, Human
gcucaucagccagcagaugcuccccucuugcacaaaacugagcagagguguccuguagcuugagu

SEQ ID NO: 4195633 - RNA, 90 nt, Human
gcucaucucagaggugagaaagaagaguguugcuaguggaugggcggggccuucccuccacuugcccucuucugugcucaccuccauagc

SEQ ID NO: 4195634 - RNA, 55 nt, Human
gcucaucugccccaggagaucccauuaagcugcggugcucugggcagcagagggc

SEQ ID NO: 4195635 - RNA, 62 nt, Human
gcucaucugggacugcagaucuucuggcacuggagcaucugugguccaucagaagaaugggc

SEQ ID NO: 4195636 - RNA, 69 nt, Human
gcucaugauucugcaggcugugcaagaagcauggcaucagccucugcuucuggugaggccucaggaagc

SEQ ID NO: 4195637 - RNA, 56 nt, Human
gcucaugcguucagcagaggcuuauugugccaggcacugagcugagcuccaugggu

SEQ ID NO: 4195638 - RNA, 67 nt, Human
gcucaugcucacugggcucugggacagcauuuucuccuuucugccuccugcccagaugagugauggc

SEQ ID NO: 4195639 - RNA, 79 nt, Human
gcucauggcucagauuuuuguaggcuuugcaaauccuccauucugucccagcagguuuccgaucauuugagacgagagc

SEQ ID NO: 4195640 - RNA, 61 nt, Human
gcucaugucauggguaauuuuaguucauaaaauguauugaacuguugcuuguaauaugugc

SEQ ID NO: 4195641 - RNA, 58 nt, Human
gcucauuaggggacuggcaacaacaaaauuaacauugagugcuaaguccuuuagaggc

SEQ ID NO: 4195642 - RNA, 128 nt, Human
gcucauuguuuuguuuuuguuauguuuauuuuuguguugaucuuuucuauuuaugguagugguauguaccuuuguuuuaauguaaaagaauaauaugguuuaaagaaaaauauuaaggaaauaagagu

SEQ ID NO: 4195643 - RNA, 55 nt, Human
gcucauuuguuacgcagcagaugcacgcugacaucuguuuuguaccagauacagc

SEQ ID NO: 4195644 - RNA, 74 nt, Human
gcuccaaauucuguguucaaacucaguccuaguuucuggcugaguuucaugaauucaugggacaaauuggaagc

SEQ ID NO: 4195645 - RNA, 68 nt, Human
gcuccaagaagugucagcuuuuuaaauuauaaauuagguuuuuuaaagagcaugggcauuuaaggagc

SEQ ID NO: 4195646 - RNA, 73 nt, Human
gcuccaaggauuagucuccccgaauggcacuauguucuagaucacagguuuccagcauggggaaggcaggagc

SEQ ID NO: 4195647 - RNA, 88 nt, Human
gcuccaccaccugcugucuggauaauccuaggagguucaccucacucucugaaccugcuuccuuuuauauuaaacaggaggcuggagc

SEQ ID NO: 4195648 - RNA, 60 nt, Human
gcuccacuaguuggguaggacugcugcugcgugcaugcacagugcugccuaauagggagu

SEQ ID NO: 4195649 - RNA, 56 nt, Human
gcuccagaguguggcaucuggguccaauaauggccauacagagccccaucuguagc

SEQ ID NO: 4195650 - RNA, 75 nt, Human
gcuccagcaaauuuuaauacugcuuuaaauaucaugacaccaugaacucuaaagaauugaaaagugcuugugagu

SEQ ID NO: 4195651 - RNA, 67 nt, Human
gcuccagcaagggucuugggguugauugucauuggcuuggcuugggucacaugcccauuacuggagc

SEQ ID NO: 4195652 - RNA, 59 nt, Human
gcuccagcgccuccuggaccuccucugccacucgcagggagcccuccaggcccugccgc

SEQ ID NO: 4195653 - RNA, 89 nt, Human
gcugcuuggguccuucagagaagugcacaaaaucagcugcaugcugguuuuacagcucugugcaugacucugaggaguuauaggguagc

SEQ ID NO: 4195654 - RNA, 65 nt, Human
gcugcuuugacauccuuguuccucaguuuguagaugacaggguugagaacaggugugagaauggc

SEQ ID NO: 4195655 - RNA, 56 nt, Human
gcugcuuugugaaaaucauucaucagauagugauuguuuuauauaagcagagcggu

SEQ ID NO: 4195656 - RNA, 77 nt, Human
gcuggaaaccaacaggcagcuagauuuauaacaacuguuugcgauuguuuuggaauuuggcuuccugagaggucagc

SEQ ID NO: 4195657 - RNA, 79 nt, Human
gcuggaaaccguuaggguacacaugauggaagguucagaaauugagggcuuucuaagugauucuagcuggacuucuggu

SEQ ID NO: 4195658 - RNA, 84 nt, Human
gcuggaaauguguaagggugugcacuaagaauuuuccagacaaagaagaaagggaaaagcaugcuacuuuauauagguuugagc

SEQ ID NO: 4195659 - RNA, 59 nt, Human
gcuggaagccguuucacccugaagccugaaggggcaaaggcagaaagcgguguucuagc

SEQ ID NO: 4195660 - RNA, 74 nt, Human
gcuggaaggcuaggcucaguugggucucucucucucucucuacauggguccaagggccacauagucucuccagc

SEQ ID NO: 4195661 - RNA, 95 nt, Human
gcuggaauucaaagcaagccuuagaggcuaagcacuggcauuucuguacccaucuugggggagagcugguagcuggcuccagggaagcauccagc

SEQ ID NO: 4195662 - RNA, 80 nt, Human
gcuggaccacucucugugguggggucaucgucagaugcuuaccagcaucccuggccuggaaccaccagauggucagcagc

SEQ ID NO: 4195663 - RNA, 61 nt, Human
gcuggacccugaaauaaggaaaugguguggauacugucucucuagcaguucagggaccagc

SEQ ID NO: 4195664 - RNA, 67 nt, Human
gcuggacgggcucugcuugccugcugugcaccugaggaguaggguuuccagguuagagagguucugc

SEQ ID NO: 4195665 - RNA, 96 nt, Human
gcuggacuccgggcgcggguggcgcggcaaaacuccgggcgcagguggcgcggcugagaggggcgcgcagcucgcgaaaugcccggcgucaaaggc

SEQ ID NO: 4195666 - RNA, 69 nt, Human
gcuggacuggcucugcccaggaaggaccuaggguucacuaagcccuggugggcaggagugagacccagc

SEQ ID NO: 4195667 - RNA, 58 nt, Human
gcuggagaaaugaaaagcuuugugaucaugaagaaacauaauguaugcauuuuccagc

SEQ ID NO: 4195668 - RNA, 74 nt, Human
gcuggagaguaguaagcaguuaguggcaaagggguuuauaaagaaacccuguggacucucuagugcuguccagu

SEQ ID NO: 4195669 - RNA, 58 nt, Human
gcuggagcauaguacuaaaguagugcacuauaagucuauuauuauuucuguguccagc

SEQ ID NO: 4195670 - RNA, 55 nt, Human
gcuggagccauuggcuuggccuuugugggguuugacauaagaagguggcuccagc

SEQ ID NO: 4195671 - RNA, 58 nt, Human
gcuggagccggcgagccccagcccagagaacaaaaggccucgcuagccggcgucccgc

SEQ ID NO: 4195672 - RNA, 60 nt, Human
gcuggagcugcagccugggccuugguuugauccuuggccuuggccuuuggccagcacagc

SEQ ID NO: 4195673 - RNA, 77 nt, Human
gcuggaggcaggaggugggagccuccagugguagggccccagacugccccacccuugacucuccuuccugucccagc

SEQ ID NO: 4195674 - RNA, 56 nt, Human
gcuggaggcaguucagacaccauguggaggugcacaaggucugaaugccucugagc

SEQ ID NO: 4195675 - RNA, 61 nt, Human
gcuggagggaagggaggaggaaaagccucaguaagaggacuccacccucucugcucccagu

SEQ ID NO: 4195676 - RNA, 58 nt, Human
gcuggagggguaauaggauggggcagacaguuauaauccuccugugacuccuccaagc

SEQ ID NO: 4195677 - RNA, 76 nt, Human
gcuggaguaggaggcgggagcaugaagucuccugggccccgcccgccaccucgcccugccgccccugcucagcagc

SEQ ID NO: 4195678 - RNA, 57 nt, Human
gcuggaguccaguggcaugaucauagcucacuauaaccucaacuccugggcucaagc

SEQ ID NO: 4195679 - RNA, 66 nt, Human
gcuggagugaagagaaggcugcuggugccugaauucuuggcucuagaaacuccaucucacuacagc

SEQ ID NO: 4195680 - RNA, 77 nt, Human
gcuggauaauaguggaggccuguugugugcauuguaggauauuuaguagcauuucuggccucuacucacuagauagc

SEQ ID NO: 4195681 - RNA, 67 nt, Human
gcuggaucagggaaggugggcauggcccuugcagcucuugcuguuucaugcagcuuuuccauucagc

SEQ ID NO: 4195682 - RNA, 55 nt, Human
gcuggaugaggcucaugcacccugcgacugaugcaccuggcugagucucauuugc

SEQ ID NO: 4195683 - RNA, 65 nt, Human
gcuggcaacaagaaaggcagagggccuuaaacguggaaaggccuuuaaagaaagucuuguccagu

SEQ ID NO: 4195684 - RNA, 63 nt, Human
gcuggcaagcaggccuggcuggaccgugggaugcagcccauaggcccaggccugccuugaggc

SEQ ID NO: 4195685 - RNA, 57 nt, Human
gcuggcaaugucugucuguaguguauucuuaacaauacagauuagcacaaugcaggc

SEQ ID NO: 4195686 - RNA, 62 nt, Human
gcuggcaggaaggcauuuagacacucaacauguauugauuuguuuuuagacuuucugcagac

SEQ ID NO: 4195687 - RNA, 92 nt, Human
gcuggcaggcaggagaguuuccggcugaggacaaggaacccguugaggcagacagcagggcucugugcagcaggagaccggcuuguuugugc

SEQ ID NO: 4195688 - RNA, 69 nt, Human
gcuggcaggcugcaggcagagccccagggagcgcuuucuagggagaagcucugucugucugccuauagu

SEQ ID NO: 4195689 - RNA, 110 nt, Human
gcuggcauugaggcgaacauaccugugaccuauggaauuggcagccagaggggagacgagagcacuggcugucaauucauaggucagagcccugugcacucggucucggc

SEQ ID NO: 4195690 - RNA, 81 nt, Human
gcuggccagcccucggguucugggagcucugaccuucaggauugcugaggccaaagcacagagcuggaagggcaggccugu

SEQ ID NO: 4195691 - RNA, 63 nt, Human
gcuggccccaagucccauggcuaguggcgagacuguaacuggccaugaacuugggaucucagc

SEQ ID NO: 4195692 - RNA, 63 nt, Human
gcuggcccuguuggcaguuucaucaguugucagcuucugagacaguaucgccccaaggcuagc

SEQ ID NO: 4195693 - RNA, 67 nt, Human
gcuggccuggggugcaggcuggcucaugaccugccucuggcacagcuugggccccaucauucucagc

SEQ ID NO: 4195694 - RNA, 59 nt, Human
gcuggccuguccugacccagccuugguaucuccggguugugaaccacagcaggccuggc

SEQ ID NO: 4195695 - RNA, 55 nt, Human
gcuggccuucucacugaucucuggguguguaaacugggcuuaugaggaggcuugu

SEQ ID NO: 4195696 - RNA, 84 nt, Human
gcuggcgguaaguuggagagaaucugaaccugcuccuauuuucaauaguagacaaauuucuucucucaauauuauugcucaugc

SEQ ID NO: 4195697 - RNA, 85 nt, Human
gcuggcggugcugaacuccugcaggccagaggggugagccugcuggaaggggcuccagcuggggugcaggaagagcauucccagc

SEQ ID NO: 4195698 - RNA, 77 nt, Human
gcuggcucagguggcuuggcagguaagcaacaggcagggucuuagguuaagagcucuuaucucuaagcacagccagc

SEQ ID NO: 4195699 - RNA, 104 nt, Human
gcuggcuccauuuucugcugauauauaguugugacccaggacaauuuauuuaaccucuuuggaacuugguuuucuaauguauuaagggaggugguuaugccagu

SEQ ID NO: 4195700 - RNA, 64 nt, Human
gcuggcugccagguacacaaguagccaggaucucugcuaggucccuucuguccuggucuuuggc

SEQ ID NO: 4195701 - RNA, 70 nt, Human
gcuggcugccuuugacuuaagggcucaguugguuaaagcccaaagcugaggcucaagucauggguccagu

SEQ ID NO: 4195702 - RNA, 59 nt, Human
gcuggcuggaguaaggagggaguaaguuucacuccguccuuugcuuccuggccuugggc

SEQ ID NO: 4195703 - RNA, 83 nt, Human
gcuggcuucaugagcuuucagaagaggaccuuuccagaaugagaaacuuggaaucuuuaggaagcacauagacaucaguuagc

SEQ ID NO: 4195704 - RNA, 59 nt, Human
gcuggcuugauaguuucugcuuccuaccucuuggaagucagucaccauuuaagaacagu

SEQ ID NO: 4195705 - RNA, 55 nt, Human
gcuggcuuuaucgucagacuccggaaaugcuagaaccugaucauaagagaccagu

SEQ ID NO: 4195706 - RNA, 60 nt, Human
gcuggcuuuguggucucuccucccugugcagguaggguguggaggguaaucagagucagu

SEQ ID NO: 4195707 - RNA, 57 nt, Human
gcuggcuuuugaagucuagcuaugucauuaaauuaguuaugugauugaaagccaugc

SEQ ID NO: 4195708 - RNA, 80 nt, Human
gcugggaaacacugugaagauuuggcaugcagaacacagacguaauuuuugcugcuuucuaucagaagagguuuuauagc

SEQ ID NO: 4195709 - RNA, 89 nt, Human
gcugggaaacuucccuucugcagaucuuuggucuuaucucuaagggcaagauccaaccgguuugcaaagggagggacuuaguucccagu

SEQ ID NO: 4195710 - RNA, 58 nt, Human
gcugggaacacagccaugagagauucugacaagucuugacuucauucagcuucccagu

SEQ ID NO: 4195711 - RNA, 96 nt, Human
ggaaggugccagggagcagugagggaucaugggcgugggacucuaacugcaucgccaucucagcugcuggccccacaugcuccaagcccaccuuuc

SEQ ID NO: 4195712 - RNA, 76 nt, Human
ggaagguggggauggaaugggaagcagagccaugagugagcagaggcucuaauccccuccacaagcuccauuuucc

SEQ ID NO: 4195713 - RNA, 104 nt, Human
ggaagguugguuguguggcugggucgugugcuuugcggggaaggcauguguugcuuuauggcuuccccacaaagcacacaaccgggucacacaacugaccuuuc

SEQ ID NO: 4195714 - RNA, 72 nt, Human
ggaaguacacuuggguugauuuucaauuuauuauugcagugauuucagagaaugaaccuaaucaacugaucc

SEQ ID NO: 4195715 - RNA, 129 nt, Human
ggaaguagcuguagaugcccacaccuauggcauagaggauggcuguaaauucagagauggacaacugaguccaaauccugcaccuacaguuuucuagcugugccaccaggacggguuccccagccuuuc

SEQ ID NO: 4195716 - RNA, 65 nt, Human
ggaaguagguaguuuccccaauuuauagcugaggcaacugagcucagggaaauucacuugcuucc

SEQ ID NO: 4195717 - RNA, 89 nt, Human
ggaaguagucguugauuugggaauggucuggcaacaugaaagagauugucugcuuccuugaucauucccaaaacuuagggagcuuuucc

SEQ ID NO: 4195718 - RNA, 107 nt, Human
ggaaguauggauggaagcauuguagcauuuuuacuugucucaaaggaaaugggauuugaugaaaaccauuagcuuaggcaugaagagaagcagagcuuccugucucc

SEQ ID NO: 4195719 - RNA, 56 nt, Human
ggaagucaggccuccacagggucuugcaggacuggggcucugucuggccuacuuuu

SEQ ID NO: 4195720 - RNA, 80 nt, Human
ggaaguccaagaucaaggugucagcagguuucauuuaucugaggccucucuccuuggcuuggagaugaauguuuuuuucc

SEQ ID NO: 4195721 - RNA, 61 nt, Human
ggaaguccugcuggaucaaccucaccugcugcuggggaggcugccauccuucaggaagacc

SEQ ID NO: 4195722 - RNA, 66 nt, Human
ggaagucuuggcagugaugcagcuuguucauuggcugaacagcuauaaucaucuguccaaacgucu

SEQ ID NO: 4195723 - RNA, 104 nt, Human
ggaagugaagguuugugcggaggagggagcuggaagcucuuccuuucaccgacacagaggaaagugcccucccgcccccucccaagcacaccccucugcgcucc

SEQ ID NO: 4195724 - RNA, 130 nt, Human
ggaagugagcaucaugauagccguuuccugccuuguuuauggcgcacuccgacucucccaccagcgccgagguggaaagaggaagugcccagcagggcgagggagacuuggggcuggcuguguuccucuc

SEQ ID NO: 4195725 - RNA, 104 nt, Human
ggaagugaguaacugccucuccagaccugcagacgacagccccgcugccaaggauagaauuaggaagaguggccaggccgacugccaggcugagggcuacuucc

SEQ ID NO: 4195726 - RNA, 97 nt, Human
ggaagugaugaugaugauuugaaaccaguuucuugauuuuuuaagaucauaaggugucucgucuucaaaucauuuaaauacauccaauguagcuucc

SEQ ID NO: 4195727 - RNA, 86 nt, Human
ggaagugcuggcgcccacuccuggaaaggcugagacagcacaggucccaaagcccagaggcugggcgugcauuacucagcaaaucc

SEQ ID NO: 4195728 - RNA, 79 nt, Human
gcugggugaccagagcuaggcagggguuucuucauguugaaaugaaacaguccucuuuauuuagucucagggcuccagc

SEQ ID NO: 4195729 - RNA, 66 nt, Human
gcugggugcuguucaucaucaugagugcugaaaugggagccucugagccugugugcggcacccggc

SEQ ID NO: 4195730 - RNA, 64 nt, Human
gcuggguggaucggaggcucugccaggcccaagacaccugcagcacgcaucccaccaccucagc

SEQ ID NO: 4195731 - RNA, 64 nt, Human
gcugggugggugcucgaggagagcuuauuuacucccuugcaaugcuuccucagccucaccuagc

SEQ ID NO: 4195732 - RNA, 82 nt, Human
gcugggugucuuuggcuugggucucucaugcaguugcugucagauaguggcaggagcagucaggggcagcuggacaccaugc

SEQ ID NO: 4195733 - RNA, 119 nt, Human
gcugggugugguggugcaugcuuguaaucccagauacuuggaaagcugaggcaggagacucgcuugaacccagggguuggagguugcagugagcccagaucgcaccauugcacuccagc

SEQ ID NO: 4195734 - RNA, 70 nt, Human
gcuggguuccucuggaggcucuaggagagaauucccuccugaagcuuuuccagcugcuagaggagccugc

SEQ ID NO: 4195735 - RNA, 73 nt, Human
gcugguaaaauaaagaguuuaguuugggauuuuugagauaucuuggaacauccaggacagauauuuugaaggc

SEQ ID NO: 4195736 - RNA, 61 nt, Human
gcugguagcuggcuuugaucuucccaucuuauuagacaggaaacaaggcuagcuugaaggc

SEQ ID NO: 4195737 - RNA, 61 nt, Human
gcugguaggagagggcuuaggggacuuuauggaauucccagagauuuccucuccuuccugc

SEQ ID NO: 4195738 - RNA, 57 nt, Human
gcuggucccaauguguuuccuucuauucuuuugacaggaagcuccuggagagccagu

SEQ ID NO: 4195739 - RNA, 81 nt, Human
gcuggucggagauguugcaacuugaauaggcauuucuaggauaccauggaaaugcacaaaguaaguguaauugcuaccagu

SEQ ID NO: 4195740 - RNA, 61 nt, Human
gcuggugaaacccacagagacccucacgcugaccugcacucucucuggguucucacucagc

SEQ ID NO: 4195741 - RNA, 80 nt, Human
gcuggugaggauggugagcuguuaagauugcaagaugauacagccacuuuggaagauaguucggcaguuucuuacaaagc

SEQ ID NO: 4195742 - RNA, 56 nt, Human
gcuggugaucuugggcaagucacuuaucucugugaagucccaguggauucaccugu

SEQ ID NO: 4195743 - RNA, 71 nt, Human
gcuggugcugcgaugauuuuacagagaagagacauuccuacuguuuacagcuuugggucauacagacaagc

SEQ ID NO: 4195744 - RNA, 84 nt, Human
gcuggugcuuuuaugaaucuagagggcucugaagagaauaucuuuaggauaauuccuuaauaucccuuuuggaagaguauuagu

SEQ ID NO: 4195745 - RNA, 61 nt, Human
gcuggugucaggggaugugcugguggccucaaggggccacacugcccaccucuguuccugc

SEQ ID NO: 4195746 - RNA, 56 nt, Human
gcuggugugcaguucugaugacaaccaaggcaacuucacacaugacugcacaaagu

SEQ ID NO: 4195747 - RNA, 60 nt, Human
gcuggugugugaaccuagggacauuauuucaccuuauagagucucaguuuccacaucugu

SEQ ID NO: 4195748 - RNA, 78 nt, Human
gcugguguucuuggaaaaacacgauagugguugaaggaaaaggaaaugcagccaucauuuguuccaagggaacuaagc

SEQ ID NO: 4195749 - RNA, 57 nt, Human
gcugguucaccuggcuccucccaggucaagcugggaacacgaaagaaggaagccagc

SEQ ID NO: 4195750 - RNA, 70 nt, Human
gcugguucccugccauaccugaaggcacagaacucauuccauugcuugcugugguuggcugguaacuagc

SEQ ID NO: 4195751 - RNA, 77 nt, Human
gcugguugauaaaucugugggagggagaaaucucauugggaagagaugcacuacccuguauuuagagaugcaccagc

SEQ ID NO: 4195752 - RNA, 124 nt, Human
gcugguugccauguggagaauggagcugacagcggggcugcuguagagaacauguugagggcgggcagauggucccagcaaggugagggauggcaggaccugcaucagugcaguggcagugggu

SEQ ID NO: 4195753 - RNA, 77 nt, Human
gcugguuggagucauggugugguuucucuuuaucuguuuauuugcucaagguacaugcauuuaugucucccaccagc

SEQ ID NO: 4195754 - RNA, 76 nt, Human
gcuguaagaaugcuuugucugcuccagacuucccgguccugggagaucagguggucaggcaaaacauccagaccgu

SEQ ID NO: 4195755 - RNA, 67 nt, Human
gcuguaagcagacucccggccagcucaaguuuccucaccugggaagaggcgggaggcuguuuaccgu

SEQ ID NO: 4195756 - RNA, 79 nt, Human
gcuguacccggaaguuccagugauauaaaacuauuuugaguuuucaaccaucauaaggaacugugacugagguuugagc

SEQ ID NO: 4195757 - RNA, 128 nt, Human
gcuguacuccagccugccacacuucugaaggcacucagugcuuaguguguuuugggcucuguauccugagaccucccacagcaugcaggccugacacuugccguggguguggagguguggaaaguggc

SEQ ID NO: 4195758 - RNA, 61 nt, Human
gcuguagaaaccaucucacugcucagaucuuaaaaucuguagccaagagaggcuuugaagc

SEQ ID NO: 4195759 - RNA, 70 nt, Human
gcuguagguaauuacuagaguuauuuagacuuaauucugugucugaaugaauucagugcuuacugccagc

SEQ ID NO: 4195760 - RNA, 70 nt, Human
gcuguagucccagcuaccccggaggcuaaggugggaggaucacuugaaccugggaggcugaggcugcagu

SEQ ID NO: 4195761 - RNA, 67 nt, Human
gcuguaguguugucuaaaugaaugcuaaagucuccaagcuuuagcuuuuaagucauaaccucacagc

SEQ ID NO: 4195762 - RNA, 74 nt, Human
gcuguaguuauuggugaacuuauuauguguguguucauauguuuuaaucaaaaugauuucaugaugauagcagc

SEQ ID NO: 4195763 - RNA, 77 nt, Human
ggacacaccacacauugaauucauucuuguagcugcuacuaggcaacaagauaaggugucaguguguggugguguuc

SEQ ID NO: 4195764 - RNA, 129 nt, Human
ggacacauggggcacuaaaaugccaagcuagcagagaacagcauugcagcuuuggauuugucuaaucucacaguggcuuugcuggucucguguuuuucuugccaguccuuuuaugcccuuggugauucu

SEQ ID NO: 4195765 - RNA, 79 nt, Human
ggacacgcugggaaauggcuucgagcucacacacugauuuucgugaguggaaagagaagcccuuucuuaggcgucuucc

SEQ ID NO: 4195766 - RNA, 70 nt, Human
ggacacuguugagcaauguacaguguauggugugcuuaccuguccacucuagagcauugcuuacagguuu

SEQ ID NO: 4195767 - RNA, 57 nt, Human
ggacacuuuaggccaccaugcaagguuuucagacuuagcauuuccuccaaagugucc

SEQ ID NO: 4195768 - RNA, 71 nt, Human
ggacacuuugggacucagcccuaguguuaucuguguggacccuagaggaacaaaugaguccuaaagaaucu

SEQ ID NO: 4195769 - RNA, 68 nt, Human
ggacagacagggguucuccuggaguaccagaaaguguaguuguacugcaggggaugcucugccugucc

SEQ ID NO: 4195770 - RNA, 75 nt, Human
ggacagacugacggcugggggcaguggucaggccacuguuugucuggcuacuuccaggggccuuaagaacugacc

SEQ ID NO: 4195771 - RNA, 82 nt, Human
ggacagaggaaaaaugcuccaaaucuguggcaaacaggauuucacugaaauuuacaggauucuuuggauaugccuuugauuc

SEQ ID NO: 4195772 - RNA, 90 nt, Human
ggacagagucucaucugucugggcugguuuuggguguggcuccgacuggaggcaagaggauagacuagaauagaugaccgcacacugucc

SEQ ID NO: 4195773 - RNA, 63 nt, Human
ggacagccgaguggccuucucccccccaacaccgguccaggccauugagacucggucuugucc

SEQ ID NO: 4195774 - RNA, 59 nt, Human
ggacagcguggcugguggagggacccugccuggcaccggcuuccaccaucacucuguuu

SEQ ID NO: 4195775 - RNA, 81 nt, Human
ggacagcgugucugggucuggcugcuggugcagcccaucucgauucuggacugagauucaguggucacacccgacgucucc

SEQ ID NO: 4195776 - RNA, 83 nt, Human
ggacaggagaggacacagcugcucugcagaggcacacagcuuguacccaaaaccugcaggagggcaggugguccucagccucc

SEQ ID NO: 4195777 - RNA, 59 nt, Human
ggacaggcgcagggccaaggaagucuuuguuuuuguuucuuucucuagcccuuccugcc

SEQ ID NO: 4195778 - RNA, 107 nt, Human
ggacagggaaagcuccagggcuugcccccuccuucugagcaccagcaagacaggugaccaccagcaggcaggugggccaagucccugucuccauguuggcccuggcc

SEQ ID NO: 4195779 - RNA, 56 nt, Human
ggacagggagucugguccuguguguccuucaccauguuacuuaaccucucugugcc

SEQ ID NO: 4195780 - RNA, 128 nt, Human
ggacagggugccugugucccacagacaggacuccuaugccccauggacagggugccugugucccacggacagggcuccuaugccccauggacagagugccuguguuccauggacagggcacccaugcc

SEQ ID NO: 4195781 - RNA, 55 nt, Human
ggacaggugacugcccagagugaacugacugguuagggcugggccuccccugucc

SEQ ID NO: 4195782 - RNA, 72 nt, Human
ggacagguucuuuugguagagugugcaucuuguucuuuugguagggugugcaucuugguaauggagcuuucc

SEQ ID NO: 4195783 - RNA, 76 nt, Human
ggacaguacagguagaagucacuaacugggacaguacaaucaaaacaauccaagugacuacugauuuuuacuuucu

SEQ ID NO: 4195784 - RNA, 81 nt, Human
ggacagugaagcaugcagggagcagaggagacacaugauaagugucugcuguuccguucucuguuugcauguacuauaucc

SEQ ID NO: 4195785 - RNA, 59 nt, Human
ggacagugggugaaauccuguagcccugggaugcagagcuucuaggagacuggcugucc

SEQ ID NO: 4195786 - RNA, 56 nt, Human
ggacaguuguuuuccagauauguuuaaaauguaggcauucuaaucaaggacugucu

SEQ ID NO: 4195787 - RNA, 119 nt, Human
ggacaguuuagacuuugccugguaggaagguggugggagagacaguggccccucaugaucccuuugggcugcaguuucuuggaugccaauuucucaugucuggccugguuccacugucc

SEQ ID NO: 4195788 - RNA, 64 nt, Human
ggacaguuucuugagaaggcuaacagcugaggacagcucuucuagcaucuggagaaacaagucc

SEQ ID NO: 4195789 - RNA, 112 nt, Human
ggacauagccgaagcucgccuuagcgaagagagucucaccuccucgggcuuugcacagaguuggagaagaggucgggaaucacagggaggcuggauuuuggcugcucugucc

SEQ ID NO: 4195790 - RNA, 59 nt, Human
ggacauaggacuuagaacuggaagacaugauuugccuuccugcuuugaguucugacccc

SEQ ID NO: 4195791 - RNA, 73 nt, Human
ggacauauaggugcuuccugucuuuugcuguuguaaaagcaauguggcaaugguuagcacuguacauaugucc

SEQ ID NO: 4195792 - RNA, 80 nt, Human
ggacauccugcucuuggguuuucuggaagccugggauuaagaagaccagaagggcuuccaguccucagaggcuggauucc

SEQ ID NO: 4195793 - RNA, 109 nt, Human
ggacaucucaccagcauagugggaggcacagcucuggaauaaugaugugaugaaauuacaacagucauuuucccugggucccucucauaagcaaagcuguugaaaugcu

SEQ ID NO: 4195794 - RNA, 57 nt, Human
ggacaucucuugccagggcugcaauccuuuauuaggcuaauuauggaaagagagucc

SEQ ID NO: 4195795 - RNA, 60 nt, Human
ggacaucugggccccaggucuaggggacuuguuccuguuuccuccuguggcccagaguuu

SEQ ID NO: 4195796 - RNA, 55 nt, Human
ggacaugcaauauugagacuuucucucuugaggaagcaguuuauaaugcauuucc

SEQ ID NO: 4195797 - RNA, 74 nt, Human
ggacauguuuucaccaugugggcaguggaggcggugaacaccacugacaguuguauuacaugggaauugugucc

SEQ ID NO: 4195798 - RNA, 62 nt, Human
ggacauuauuuucccucagaucuuauaguccugucuuauggaacuauggaggaaauaagucc

SEQ ID NO: 4195799 - RNA, 86 nt, Human
ggacauuccagcuauggucauaacaugauuaguaggugguaauucauaacuugguacagcuaugaagaaauaguauggaagagucu

SEQ ID NO: 4195800 - RNA, 129 nt, Human
ggacauugccagugacccaggccccguccuuaccuucaaggcuguugcgagguagugagggaggcuggcagcguaguaggagcauugaggguauggaggugaggccagggggagccaucaggcaggccc

SEQ ID NO: 4195801 - RNA, 66 nt, Human
ggaccaagcgucuaauuggggguugcccaggucucacuggugccuggcuucccuuggagcauuucc

SEQ ID NO: 4195802 - RNA, 67 nt, Human
gcuuuugucauuucccugauuaaagccuuucuauggcuccauguuaggcaaugaugcaauucaaagc

SEQ ID NO: 4195803 - RNA, 59 nt, Human
gcuuuuguuucuguuuauuuuugugugaggagugugcacauguagaugaaagcaaaggc

SEQ ID NO: 4195804 - RNA, 70 nt, Human
gcuuuuuagaggaggaaacugaggcucuguguauuugagagacaaccucagggucauccuaguaauaggu

SEQ ID NO: 4195805 - RNA, 73 nt, Human
gcuuuuuagcaauaugaaugcauuugcacauuaccuccauaacaugcaaauacuucuguauaugcuggacugc

SEQ ID NO: 4195806 - RNA, 74 nt, Human
gcuuuuuccuuggagagggagaaaaauaacauucugguuucagaugcuguucuuucccuuuuuaaaucuauggc

SEQ ID NO: 4195807 - RNA, 66 nt, Human
gcuuuuugagaguauucacuuagucauccaacuggugacaaagucaacaguacucucagaaccagc

SEQ ID NO: 4195808 - RNA, 69 nt, Human
gcuuuuugguuuuauugagaucgaagugauggacacagaagccagauuguagugggacugggacuuagc

SEQ ID NO: 4195809 - RNA, 79 nt, Human
gcuuuuuuauuauugacagaugcauuauguuguaagcccauaaguggcuacaucuauuucuccucugucagaaagaagu

SEQ ID NO: 4195810 - RNA, 79 nt, Human
gcuuuuuucuaguuacaggaguuucugaaauugacaaacauguaaggaagucaauaaagaaaaagucugugagaugagc

SEQ ID NO: 4195811 - RNA, 71 nt, Human
gcuuuuuucuuguuuagauucuuugucuugugcuuccuguaucuuauauggcuucugaggaauggaagagc

SEQ ID NO: 4195812 - RNA, 79 nt, Human
ggaaaaagaaguuguauggggaggcugucgagugacaacacggauuuuuauuaaccuccugguccagcaucucuuuucc

SEQ ID NO: 4195813 - RNA, 92 nt, Human
ggaaaaauagccaugauuuucucauuuucaugugguauucuauuuuuuccuucauuugagauguaauagaaaauugcuauucugaaauuucc

SEQ ID NO: 4195814 - RNA, 73 nt, Human
ggaaaaccuguaguuuucuuaccacuaugaaaugaagccauuggauagacauaagaaaaauuuuaggucuucc

SEQ ID NO: 4195815 - RNA, 79 nt, Human
ggaaaacuaugagcuuuggaaugagaaacaccugcacaauccugggcaaguuucuugaccuuucugagcucucauuucc

SEQ ID NO: 4195816 - RNA, 82 nt, Human
ggaaaacuuaugugcuuuagaucugacuuucugugcaaaaaugugagauuugcuacaggugggacccaggucugaguuuucu

SEQ ID NO: 4195817 - RNA, 56 nt, Human
ggaaaagaaagggacugauuggaaaggauaguucugucuccacacccuuuccuucc

SEQ ID NO: 4195818 - RNA, 67 nt, Human
ggaaaagaguagcugucuccuagaaacugaaggaacccuuuacaacuguagcagugugcucuuuuuc

SEQ ID NO: 4195819 - RNA, 56 nt, Human
ggaaaagcacauucaauuuuguaugagaucucucaaacauuugaagucgcauuucu

SEQ ID NO: 4195820 - RNA, 70 nt, Human
ggaaaagcaucucuauguggagaguggagagcaguggcgcauuuuauuugacaugguggauuugcuuucc

SEQ ID NO: 4195821 - RNA, 93 nt, Human
ggaaaagcuucauguugguagcugauauuagcaaugagugccuccgaaaugugaauuuggaacugcauaaugauucugcugccucuuuuuucc

SEQ ID NO: 4195822 - RNA, 60 nt, Human
ggaaaaggaugcagggacccaaggcuuuuuaaguguaacuagucugccugcuccuucucc

SEQ ID NO: 4195823 - RNA, 57 nt, Human
ggaaaagggguggacugugauggcugacuucagccuuccacccagauccccuugacc

SEQ ID NO: 4195824 - RNA, 94 nt, Human
ggaaaaguccaagucuaggcccaagaaucacuggauguugcuccuguaagagugcuuucagaaauacacuagucucuucuugacuugggcuucc

SEQ ID NO: 4195825 - RNA, 75 nt, Human
ggaaaaguguuaagguguugauaauuccaagaaagcuuuuauuuguccuacaaucauuacuuugauaccuuuucu

SEQ ID NO: 4195826 - RNA, 121 nt, Human
ggaaaauaaaauauugccagucucuuuagucauuguaugaaguguacucauuaaaggguuaccucuuaagcugagcccagagaacagucaguacaaugaaagguauggcaaccaauuuucc

SEQ ID NO: 4195827 - RNA, 55 nt, Human
ggaaaauacugauucaugccauaauaaucacauggaagagucaggccaauuuucc

SEQ ID NO: 4195828 - RNA, 56 nt, Human
ggaaaaugaacuggagaacaaugacccauuucugggucuguucacuguucaguucc

SEQ ID NO: 4195829 - RNA, 59 nt, Human
ggaaacagucugggaguuccuuauaagguuaaacaguuaccuuauaacccagaaauucc

SEQ ID NO: 4195830 - RNA, 66 nt, Human
ggaaacauugaagcugugaaaucaaacaauuuacacgagugagaaguucagcauuuggauguuucc

SEQ ID NO: 4195831 - RNA, 71 nt, Human
ggaaacauuuuuacugggcaucugcaucaaaauucaugugcagcuagcgugccuagugaagcauuguauuc

SEQ ID NO: 4195832 - RNA, 58 nt, Human
ggaaaccaaacauuugcgguggugcgggggguuccguggcugcagguggguuuggucc

SEQ ID NO: 4195833 - RNA, 99 nt, Human
ggaaaccagagcccggaauguuaguuugaacuugucuauguuacauaccagguaaacaugggugcuucaaacuaaauaugauuccacagcccucauucc

SEQ ID NO: 4195834 - RNA, 71 nt, Human
ggaaaccagucagucucuauuccagccaccucugucagaacagggcuggggaaagaggcuaacugguaucc

SEQ ID NO: 4195835 - RNA, 70 nt, Human
ggaaacccaguacuguuuuccauaguggcugcaccauuuggcauucccaccaacaauguacaggguuucc

SEQ ID NO: 4195836 - RNA, 78 nt, Human
ggaaaccggcuggagaggauuuagaaggacuacagugugaugguaucuugcuuccuuuuaauuaccagcugagugacc

SEQ ID NO: 4195837 - RNA, 88 nt, Human
ggaaacgcaggcgcagaaggccaggggccuggagggcuaacuccagccucagccccccauagugccccaggccuucuggcuucauucc

SEQ ID NO: 4195838 - RNA, 122 nt, Human
ggaaacucauugagucaugcaaauguaaaggaacagagaagcuuuacuaaaguucaguacaaguguucuguguuuuucacuaggcauccuguauuuuuauuugcuagaccuggcgaucuucc

SEQ ID NO: 4195839 - RNA, 58 nt, Human
ggaaacugagauucaaagagguucagugucauaucuggccaagauaaucucaguuuuc

SEQ ID NO: 4195840 - RNA, 68 nt, Human
ggaaacuuggcauaauuuuaaguagaugggcuggacauuauauuauguguauugugcuaaugguuucc

SEQ ID NO: 4195841 - RNA, 80 nt, Human
ggaaagaaauaggccugcuuaagguucaucuccacgugugcuuguaaaugaacucaccuuggcaguuucuaccuuuuucc

SEQ ID NO: 4195842 - RNA, 88 nt, Human
ggaaagcaagcaucaccuucugcaaucaugacaagaggcuuuuauucucagcaggcacuugaucauuguuacagaugcuuucuuuacc

SEQ ID NO: 4195843 - RNA, 78 nt, Human
ggaaagcggcaggugauucagcaauuuuuguagcacgacagguugugcacaaaguguuuucugaaggccugcacuucu

SEQ ID NO: 4195844 - RNA, 77 nt, Human
gcuucucugucauuggggaugugugaaccaguccacugagaggcccagcacacggaaucccuuuugugacacagggc

SEQ ID NO: 4195845 - RNA, 58 nt, Human
gcuucugaaucccacccaacugcugcuguccagggacagccaggaugggagcagaagc

SEQ ID NO: 4195846 - RNA, 90 nt, Human
gcuucugaguuucugugaauucugcaguaauggccccccacucaaccuugcuuacuguuucaagcccucacagacaaugagcauuagagc

SEQ ID NO: 4195847 - RNA, 121 nt, Human
gcuucugaugcacugucauuuggaaaccacugcccuaggucaaaccaugccaugauaguucccacaucacgucaugguuugaucuggacuuuaggaaagugacugguggcaggcuugaagc

SEQ ID NO: 4195848 - RNA, 57 nt, Human
gcuucugcagagccguccugaggcucugacaucuaugagucggcggccagcagaggc

SEQ ID NO: 4195849 - RNA, 63 nt, Human
gcuucugcuggcugugcaaaggcauggggaaaugcucugugugugaacacagcccagcagugc

SEQ ID NO: 4195850 - RNA, 67 nt, Human
gcuucugggguucuggcaugcucauuacuucccuucugaccaucuucccuauggaccccaggccugc

SEQ ID NO: 4195851 - RNA, 65 nt, Human
gcuucuugccuguguagagaaucucauggaaaaccuggguacuaacguucuuucauaguaagagc

SEQ ID NO: 4195852 - RNA, 55 nt, Human
gcuucuuguagcccccuugaccucaccaguaaggcagcuaagggggaaacggagc

SEQ ID NO: 4195853 - RNA, 72 nt, Human
gcuucuuuauugacucccagcuuuuccaacucugguugugaaccuuggugagucaguauucauuagaggagc

SEQ ID NO: 4195854 - RNA, 65 nt, Human
gcuugaaaauguuuuuuggucugaugaaugcaaucaucaucaucaacaagaaacauuuguugagu

SEQ ID NO: 4195855 - RNA, 80 nt, Human
gcuugaaacugagaucaaggugucauuucucugcaggugcuaauauugcccaugauggggaaagauaccaucuaccaagc

SEQ ID NO: 4195856 - RNA, 89 nt, Human
gcuugaaagagcuccugcugcauccugccugguccagagcaacaggaauaaccacccaggucagugagugcacaggagcuaaaucaagc

SEQ ID NO: 4195857 - RNA, 87 nt, Human
gcuugaacauauccuuguacuauaguauuuauaaguuuuguuauuauuguuauggguacuaguauuagugauacugaauguguaggc

SEQ ID NO: 4195858 - RNA, 64 nt, Human
gcuugaacccaggagguugcagugagcuaagauugagccacugcacuccagugugggugauagc

SEQ ID NO: 4195859 - RNA, 70 nt, Human
gcuugaacccaggguggagguugcagugagccgagaccgugccauugcccuccagccugggugacaaagc

SEQ ID NO: 4195860 - RNA, 80 nt, Human
gcuugaagagagcuaagggccuuguccacugcaagccagcaaggaauggagccaggacaaagcucugcugccucccaggc

SEQ ID NO: 4195861 - RNA, 81 nt, Human
gcuugaagcuagaaacacagaucuggugucaucagcugacauugcucuagaucguuucgaaguucuuuuuuaauucaaagu

SEQ ID NO: 4195862 - RNA, 72 nt, Human
gcuugaauccaggacuucgaggcuacagugggcugagauugcaccacugcacucuagcuugggugacagagc

SEQ ID NO: 4195863 - RNA, 104 nt, Human
gcuugaauuuagcacaugugcaugacaguucuacacuuaaucuguaauucagcagaaucaggaccuguggcugucuuacauuugggcuaauuuuucuuaugagc

SEQ ID NO: 4195864 - RNA, 68 nt, Human
gcuugacagugucccucugggguggaaaugaguuccuuagcuccaucaccacagaggacagaguaagc

SEQ ID NO: 4195865 - RNA, 79 nt, Human
gcuugaccagacaucaauuucaaaggcaugacaaagaccccaacaagcaucuuccaggaagcugaugucuagucaucgc

SEQ ID NO: 4195866 - RNA, 72 nt, Human
gcuugaccucugaccuggccccucaaagcugggcaacugaggacauuccagccaccaggucugaggccaggc

SEQ ID NO: 4195867 - RNA, 69 nt, Human
gcuugagcccagguugaggcugcagugagcuaugaucacaucacugcacuccagccugggucacagagu

SEQ ID NO: 4195868 - RNA, 81 nt, Human
gcuugaggagcaguagaguacauggcuccgcaaugucuucaaagaccugggcuuucguuucucuacucugccauccucugc

SEQ ID NO: 4195869 - RNA, 97 nt, Human
gcuugagugaaucagggcugaagaucagaaguccccagucaaggagcuuuccccacuaaugagcucuccgagggccucugacagccccucccuuugc

SEQ ID NO: 4195870 - RNA, 58 nt, Human
gcuugaucucugcccucauguagcugacacacugaggcaacugagaccacagacaagu

SEQ ID NO: 4195871 - RNA, 83 nt, Human
gcuugauguuguaaaaaguacacuacguggaguuagaaacccucagugucuaaccuuguggucugcuggugcuguucuuaggc

SEQ ID NO: 4195872 - RNA, 60 nt, Human
gcuugcacaggaucugaagugggcuuggagcauccaagaaucccaaggcccugggcaggc

SEQ ID NO: 4195873 - RNA, 64 nt, Human
gcuugcaggagguugagccaggacugacgcuccaagucugucugaauccuaagcuuccucaagc

SEQ ID NO: 4195874 - RNA, 96 nt, Human
gcuugcaugaucgccccauuaggcagacaacguagccggagaucacaaaucaggcccuuggcuguaguugcuaguguguggaggugcagagcaggu

SEQ ID NO: 4195875 - RNA, 56 nt, Human
gcuugcugcucuggagucaugcccuuccagcaauagggcaggacccgguagggagc

SEQ ID NO: 4195876 - RNA, 65 nt, Human
gcuugcugggcucaaccuccagagcuucugauuuaccaggcuuggggugagggccaagaauuugc

SEQ ID NO: 4195877 - RNA, 68 nt, Human
gcuuuugucauggugacucagucacaugaaauuacugaccuacauugaugacuguuaucugauaaggc

SEQ ID NO: 4195878 - RNA, 83 nt, Human
gcuuuuucaccccaauagcucacagaauaugaugauuguuauauagaucaaaugaugcuaauuggaucuggugaccaaaaagu

SEQ ID NO: 4195879 - RNA, 66 nt, Human
gcuuuuuugaugcaaaaacucuaggaauaguagcccuaugucucagaguguuguauuagagaaugu

SEQ ID NO: 4195880 - RNA, 91 nt, Human
gcuuuuuuugugugagcuucaguauuagaaguuuuagcuggauuuaaugcuaaauugcuuauaaagaugaaugaagcugcacagggaaagu

SEQ ID NO: 4195881 - RNA, 100 nt, Human
ggaaaaagggggaaaggcuaauauauguucaugucaaacaaaugccuucaagggcguaguugugcagcgaggauaguccuuuacuuuugccucauauucu

SEQ ID NO: 4195882 - RNA, 64 nt, Human
ggaaaaaguggcaagucaaugauagugacccagcaugguuacauuuggcuauguccucuauucc

SEQ ID NO: 4195883 - RNA, 74 nt, Human
ggaaaacauaauuuagcucuaccagugcauuugugcauacaaauguguauaagggagagcuaaauaacuuuuuc

SEQ ID NO: 4195884 - RNA, 68 nt, Human
ggaaaacuguguuuuuggucugaucuaucagaucaucauugaagaucaagaucagagaacagcucucu

SEQ ID NO: 4195885 - RNA, 101 nt, Human
ggaaaacuugauagagagaugaaaauaucaaaguaggcauauguuuuuaugaaaguuucagaaaaguauguuuauuuugacuuaugucuaaauuagauucc

SEQ ID NO: 4195886 - RNA, 56 nt, Human
ggaaaagcuuuguuuggccauagggcucuacucucccuagcuuagcauacuuuucc

SEQ ID NO: 4195887 - RNA, 57 nt, Human
ggaaaaggaaagcaguauaagguuuucccuacuucuucucugcuuugccuucauucc

SEQ ID NO: 4195888 - RNA, 108 nt, Human
ggaaaaggaacgauggacauagcuucauacugucagagccugaaggggucuuggaaaagcucuaggucaggaauggcuugcaggcugucacuuuccauucccuuaucc

SEQ ID NO: 4195889 - RNA, 58 nt, Human
ggaaaaggaggaauguagccagcuccccacucaggacgcuuccucauuucucuucacc

SEQ ID NO: 4195890 - RNA, 65 nt, Human
ggaaaaggcuuaaagaauuaacagagaugucagaccugacauaguuaagucauugagccaacucc

SEQ ID NO: 4195891 - RNA, 77 nt, Human
ggaaaagggggacaggagcaaaugaugggggcaggcgguaaaugacccaaauuucagugucuucuucucccucaucc

SEQ ID NO: 4195892 - RNA, 103 nt, Human
ggaaaagugcaguauuagggugggagugucccgauuuuccagguaccaucuguuauggcuucccuuugccaggaaagggaauucccugaccccuugugcuucc

SEQ ID NO: 4195893 - RNA, 106 nt, Human
ggaaaauacuuuucagaaauauguuacguauuccugagcaguaaaaugggcaacuucacacaugcugauaagaauauaaaauggcacauuucugaagggcaguucc

SEQ ID NO: 4195894 - RNA, 78 nt, Human
ggaaaaugacaaaucuacauaaaacgaauacauaguccugaaagggucuaugaauugcauuuauaguuguccuuuucc

SEQ ID NO: 4195895 - RNA, 80 nt, Human
ggaaaaugaguuugccucuagauagcaaggcuuguuuuauagacaaucugauuuuccuagucagaggcaaggcauuuuuc

SEQ ID NO: 4195896 - RNA, 101 nt, Human
ggaaaauggaaaagucuggcauuggagcaguccgcagaacaaggaaaaaacagcuuugcuuugcuuggcccauugcuucaguaucuuauaguugguuuucu

SEQ ID NO: 4195897 - RNA, 64 nt, Human
gcucugccaucuucucuggggauguuggcuuguucuuaacuccucaaauauggggugguagagu

SEQ ID NO: 4195898 - RNA, 68 nt, Human
gcucugcgcugcacucaucugcagucggcugugaguuggcuaggcagcucugcugguggugccagggc

SEQ ID NO: 4195899 - RNA, 71 nt, Human
gcucugcucucuuuacccucugagacaagaaaccccacauagacuucucagaggugguaaaggacagcagc

SEQ ID NO: 4195900 - RNA, 65 nt, Human
gcucugcugacagcugggacagggugggcacuuggcuucccagaagucugagcuguugcagcagc

SEQ ID NO: 4195901 - RNA, 59 nt, Human
gcucugcuguaaugagucagcaucuagaaagucagagcacugcugauuuacaguccagc

SEQ ID NO: 4195902 - RNA, 63 nt, Human
gcucuggaaaggauugaagccucgcacugaaucccagugaccuccaauaccuuucuucccagc

SEQ ID NO: 4195903 - RNA, 102 nt, Human
gcucuggaccugggggucugcuguagguaggacagcaccuccuucccuuauccuuggucugugggugcugcccucccugcccagcuacucacauacagaagc

SEQ ID NO: 4195904 - RNA, 130 nt, Human
gcucuggagcauccgccacaucuuaggcuggacagccaaucacaugccaagggaggcugggcucccccuuccaggggcucucagggugugugcuguggaugugugcccaagaagguguguguguucaugc

SEQ ID NO: 4195905 - RNA, 82 nt, Human
gcucugggaacuggggagucaagcaucaaggcaccagccaguucugugucugaugauagugucucuccugguucauagaugc

SEQ ID NO: 4195906 - RNA, 59 nt, Human
gcucugggcugaaucauuuaucugauuauguggacuaaaagaauguagagguccagggc

SEQ ID NO: 4195907 - RNA, 62 nt, Human
gcucuguacguagcacugagagaugcagguaauuguuggaguugcccacggugcuguagggc

SEQ ID NO: 4195908 - RNA, 72 nt, Human
gcucugucacccaggcuggagugcaguggcacgaucucggcucacugcaaccucugccucccggguucaagc

SEQ ID NO: 4195909 - RNA, 64 nt, Human
gcucugucaguugaggacucaccuuugaagccacucuggugcuucugucuucccacugaggagc

SEQ ID NO: 4195910 - RNA, 82 nt, Human
gcucugucgcuaggccggagugcaguggugcgaucucgguucacugcaaccucugccucccagguucaagcgauucuccugc

SEQ ID NO: 4195911 - RNA, 105 nt, Human
gcucugucucuccuuggcucggugaccagccagugcugucugucaagggcuggccucugcggggcagaugcuccuggcucuucccgacaggugagaaauggaagc

SEQ ID NO: 4195912 - RNA, 60 nt, Human
gcucugugcucccaugcuaguaacuuaaccucucugaguguguacuaguuaaguacaggc

SEQ ID NO: 4195913 - RNA, 59 nt, Human
gcucuguggcuacacaaaccuccaaagccucacccauggagguagucugagucauaggc

SEQ ID NO: 4195914 - RNA, 67 nt, Human
gcucugugugccagagggcuccauggcagagcaggugugcaugcucaggccucggacacacaauagu

SEQ ID NO: 4195915 - RNA, 68 nt, Human
gcucuguuaagucuggaaugaaaguuaucuuuaacagccagacuuucagacucagaacuuagcaaagc

SEQ ID NO: 4195916 - RNA, 68 nt, Human
gcucuguucuaagcauucuauguggauuaacucauugaauccucguaggaacucuuuuagaaauaugc

SEQ ID NO: 4195917 - RNA, 94 nt, Human
gcucuguucuggucacuaugcugggcaacggaagagagaaauuaauaagacuuaauuccugccuuugaauugcucacagugagaugggacaggc

SEQ ID NO: 4195918 - RNA, 55 nt, Human
gcucuguuuaucccugacaauuaucuauagcagaaugaagggggauggacagggc

SEQ ID NO: 4195919 - RNA, 76 nt, Human
gcucuuacucagggagucuuuugucacuggguagugugguaguugagugauucccagacuuccugggaaacagagc

SEQ ID NO: 4195920 - RNA, 103 nt, Human
gcucuucauggcagcugggagcagugggccaggagucacccgggcaugaccaugugguguggccaggucagggacuuguggcuccugccccucccuuuggagc

SEQ ID NO: 4195921 - RNA, 65 nt, Human
gcucuuccucuuuagucuguguggagaagcuaugaaucauucauggucucccagcugagaagggc

SEQ ID NO: 4195922 - RNA, 116 nt, Human
gcucuucucuucuugucauauuuuuaauauugcaugcuuuuuuccagccuguauaccagugcuauuuaaaggaaaagaauugcagugaaguaauaguuugacggcuccugaacugc

SEQ ID NO: 4195923 - RNA, 69 nt, Human
gcucuucugccuggcucauggcagugaggagacccacgcucaccuucgcugccugggucaaguagcugc

SEQ ID NO: 4195924 - RNA, 80 nt, Human
gcucuucuucaaaauuaaaguaugguuuaagggcuucaaauaaacugaagauuuucucaacuguauuuguaaaagagagc

SEQ ID NO: 4195925 - RNA, 69 nt, Human
gcucuugaggaagugcagggcagugagauuccagagcagcugccaccccucugcacccucaggucaggc

SEQ ID NO: 4195926 - RNA, 70 nt, Human
gcucuugccucauggcggcugccccaggccaaguuucugccugccugccagcagccucaacaggcacagc

SEQ ID NO: 4195927 - RNA, 96 nt, Human
gcucuugcuguucccuccaccuggaguguucuucccccaaagcaguacacaguuguuuacugcaugaaggcaccuauuugggggguuagugggggc

SEQ ID NO: 4195928 - RNA, 59 nt, Human
gcucuuuagggaucucuggggaaauggagugccuuccucaacaacuucccuacagaagc

SEQ ID NO: 4195929 - RNA, 62 nt, Human
gcucuuuuccuucccuacagaucucagccagauuggugauggaaauggaaggauaaagaugu

SEQ ID NO: 4195930 - RNA, 67 nt, Human
gcugaaaacugaggaacaaggaaggauucugagaggucaucuaauaucuuuccuguuuucagacagc

SEQ ID NO: 4195931 - RNA, 76 nt, Human
gcugaaacucuucauucaaguaugcaaaugauacucaauuuguaagauucacuuggaagaaauaaagagguauagc

SEQ ID NO: 4195932 - RNA, 63 nt, Human
gcugaaaggggugacauucuuuucucagaagcaagacugucuaaaggaagcucccccuacagu

SEQ ID NO: 4195933 - RNA, 84 nt, Human
gcugaaauaaauugucaaauauaugcaaaacuauucaauauaaaaagaaaguaaaauguaauguuugaaauuguuuguuccagc

SEQ ID NO: 4195934 - RNA, 69 nt, Human
gcugaaauaccaguggccauaaaggaaggcaguggaaacaggcuuugcuuuacucccacuguguucugc

SEQ ID NO: 4195935 - RNA, 72 nt, Human
gcugaaauagaaacagaauaugagugagaggcugucccuaaacaccuauaguuaacucuguucuaggucagu

SEQ ID NO: 4195936 - RNA, 65 nt, Human
gcugaaauagcauguuaauaaccagaguagcuaucagcaccuccuuggucaauugacaugucagu

SEQ ID NO: 4195937 - RNA, 55 nt, Human
gcugaaaugaaaacacaggucgguagauuccaacucuaagaccuuucacuucagc

SEQ ID NO: 4195938 - RNA, 56 nt, Human
gcugaaaugggcacugaaggccucuccaaguggaggggccuuggccucuuugcagc

SEQ ID NO: 4195939 - RNA, 62 nt, Human
gcugaacaguaucuuuuaucagaaauacugaacaguauuucugauacaguguacugaauagu

SEQ ID NO: 4195940 - RNA, 62 nt, Human
gcugaacucuggaagggugaggcugugucuagcuugcuacagcuguauccccagagcucagu

SEQ ID NO: 4195941 - RNA, 66 nt, Human
gcugaacuuaugugggacugcaauggcagugaaccagugugagcagagccugacaugaggagcagc

SEQ ID NO: 4195942 - RNA, 100 nt, Human
gcugaacuuuacacagcuuuuacauuucccucugucaguuccucuuguaaugguggguggguagcugaagggaggauauguacaauaauguauuuuuagu

SEQ ID NO: 4195943 - RNA, 87 nt, Human
gcugaagaaaauucacaugugcuucuuaucacugaaauuuaauauuguuugggguugauuauuugcauuugucaauuuucauucugc

SEQ ID NO: 4195944 - RNA, 115 nt, Human
gcugaagaaagcacauaguugggggucuuagauagguuuggaagccauauggacuucuuuuaaugagggagggcuuuugcaauccaagucucaaagcuguguuguucuaaucagc

SEQ ID NO: 4195945 - RNA, 68 nt, Human
gcugaaggcaauugagaagaaacagacacauaaaaagcucucugcccuccccuuauuugccuaaaagc

SEQ ID NO: 4195946 - RNA, 88 nt, Human
gcugaagucaagagacuggcuuuggagccuguguucugccucuucugagagagcacagugagcuugagaaagauagucuaccuucagc

SEQ ID NO: 4195947 - RNA, 73 nt, Human
gcugaagucacuucuuaggaaaggagucaauaaaguuugaauuguucccagucaaacgaaggacuuccuuagu

SEQ ID NO: 4195948 - RNA, 99 nt, Human
gcugaagugguugaacaugaaaagacuugggugaaguaauuuuauagagaggaaaaguuucuuugcugccaaguuuguuuaucuugucauacuauuagu

SEQ ID NO: 4195949 - RNA, 78 nt, Human
gcugaauaaaugcuuauauauguguguguguguguguguguguguguguguguguguguguaaaagcauuuauauagc

SEQ ID NO: 4195950 - RNA, 65 nt, Human
ggaggugagcagcccuuccuccggccacucaaguaguggggacugggaggaggggcgcuuugucu

SEQ ID NO: 4195951 - RNA, 63 nt, Human
ggaggugaucagaguuuugaggagcaaaaggccuaaacauccucuugcucuguugucacuuuc

SEQ ID NO: 4195952 - RNA, 55 nt, Human
ggaggugccuguaaaaaugagcauguuuuauucuagguucauuucuaggcacucc

SEQ ID NO: 4195953 - RNA, 75 nt, Human
ggagguggcaucuaaacuugcaucauugucuuuauuccuuuaaugcauaguugaugagguuggguauccauuccc

SEQ ID NO: 4195954 - RNA, 118 nt, Human
ggagguggcgcagcgcaucacggcggagcugaagcgcuacagcaucccgcaggcaaucuucgcgcagcggauccugugucgcucucagggcacgcucuccgaccugcugcgcaacccc

SEQ ID NO: 4195955 - RNA, 55 nt, Human
ggaggugggaguuuaguucuugaccugugcugcucaaugcuggcuucccaccucc

SEQ ID NO: 4195956 - RNA, 93 nt, Human
ggaggugucuugcuuuuuggggggcccugaaguagggaggguacuguuucuuuucugaaagauguucagggcccugagagggcagucacguuc

SEQ ID NO: 4195957 - RNA, 81 nt, Human
ggagguguggggaggagagagcccuuucugauuaauaacuagcaggguaauguugagggcuuuuucugcccgauugccuuu

SEQ ID NO: 4195958 - RNA, 63 nt, Human
ggagguucugauuugucacaacuuaauuauacauucuugugacuacagagauccagaauuucc

SEQ ID NO: 4195959 - RNA, 89 nt, Human
ggagguugggcguuuugucuuucucuggaacaguaaaacguuagaaaaccauuuuccuuuuacagagaaagaacaagacucuuaccucu

SEQ ID NO: 4195960 - RNA, 97 nt, Human
ggaguaaauauagauagcaaagaaccugauaccccaagaaaccaguuucuaccaugaucugggggauuuucucauauguuacuauuuaauuugcuuu

SEQ ID NO: 4195961 - RNA, 66 nt, Human
ggaguaagacccacaagauuuaauaggcuggaaaagaccugggaggcugugggucugcugagcucc

SEQ ID NO: 4195962 - RNA, 86 nt, Human
ggaguaagaguaaguugguggucggcauaaugaauggcugugaugucaaggccaggaucuguuuguccaccaaucuuuccuacucc

SEQ ID NO: 4195963 - RNA, 81 nt, Human
ggaguagcuggcuggaggaaucacagaaggcuuccuggaggaaguggcuuugagcuucugccaucuccaugcagcuacucc

SEQ ID NO: 4195964 - RNA, 77 nt, Human
ggaguaggaugugauacuccuucuaguggaaauaccagucaaauguccgugggucuugaagugucacugcauacucc

SEQ ID NO: 4195965 - RNA, 74 nt, Human
ggaguauaaggaaagaguccuucuuuguuuucuucuuugguggccaaagaagagcuggaaggagucuccuuucc

SEQ ID NO: 4195966 - RNA, 82 nt, Human
ggaguaucacaguaaauuggcaauggagacuaagugugaauucagacacccagagcgccagugccgagcuuuuaccugcucu

SEQ ID NO: 4195967 - RNA, 61 nt, Human
ggaguaucuggcacauccagcugugcucuagccuggagcuggcuggcauagccauugcucc

SEQ ID NO: 4195968 - RNA, 76 nt, Human
ggaguauucuccaggugcuaagugugccuuuugcuccuuuugcaaauagacuugcaggcugcccugggggagcugc

SEQ ID NO: 4195969 - RNA, 59 nt, Human
ggagucaaggaaggcucugugaugggcucuagcagccaugagccccugccuuguacucu

SEQ ID NO: 4195970 - RNA, 70 nt, Human
ggagucagaaguucuagauuugaguccuaaauuuaucguuuuaggucaacuuggaugacuuuucagcucc

SEQ ID NO: 4195971 - RNA, 58 nt, Human
ggagucagccugucagaguguaggcuuuaugcuugugucugugccugggcuggcugcc

SEQ ID NO: 4195972 - RNA, 59 nt, Human
ggagucagggaggaaggggugcuuggaggcagcccaagacaaacuuccuucacugcacc

SEQ ID NO: 4195973 - RNA, 88 nt, Human
ggagucccaugagguagaagagccaggacagauccagcuucacacucagacuugggcuguuuccuccugaugcucuacagccuccucc

SEQ ID NO: 4195974 - RNA, 101 nt, Human
ggagucuaacucccugcagcuaacaacacauaaauaugaaugauaagaguuauuagcaauacaucuugucagauucauguguugcaguuagguugggcucc

SEQ ID NO: 4195975 - RNA, 64 nt, Human
ggagucuauaucucaugagugcucccaccaauggugcucagcagaaaugaugguaugggacuuc

SEQ ID NO: 4195976 - RNA, 101 nt, Human
ggagucucacccacaggaacgcgcaccagcugcuggguucuagagaguuccagaagcacugacgaucuucccggcaugcggugugagcccggugaugcccc

SEQ ID NO: 4195977 - RNA, 88 nt, Human
ggagucucacucuguggcccagguuggagugcagugguguaaucucagcccacugcaacuucugccuccuggguucaagugauuaucc

SEQ ID NO: 4195978 - RNA, 86 nt, Human
ggagucucacugucucccaggcuggagugcaguggcacgaucucggcucacugcaaccuccgccuaccggauucaagugacucucc

SEQ ID NO: 4195979 - RNA, 88 nt, Human
ggagucucacuuugucacccaggcuggagugcaguggugugauaucggcucacugcaaccuccaccucccggguucaagugauucucc

SEQ ID NO: 4195980 - RNA, 62 nt, Human
ggagucuccaugugccccucagcuugugcccacagaugugaggacucauguggaggauggcc

SEQ ID NO: 4195981 - RNA, 88 nt, Human
ggagucucgcucuguagcccaggcuggagugcaguggcaccaucuugguucacugcaaccuccgccucccagguucaagcgauucucc

SEQ ID NO: 4195982 - RNA, 87 nt, Human
ggagucucgcucugucaccaggcuggagugcaguggcacaauuuuggcucacugcaaccucugccucccggguucaagcgauucucu

SEQ ID NO: 4195983 - RNA, 87 nt, Human
ggagucucgcucuguugccaggcuggagugcaguggugugaucucggcucacugcaagcuccgccucccggauucaagugauucucc

SEQ ID NO: 4195984 - RNA, 88 nt, Human
ggagucucgcucuguugcccaggguggagugcaguggcgcgaucucggcucacugcaagcuccgccuaccgggcucacgccauucucc

SEQ ID NO: 4195985 - RNA, 62 nt, Human
ggaaugcacugguucuuucccauaguuugcauuuaaacugugugaaacaucaaugugugccc

SEQ ID NO: 4195986 - RNA, 55 nt, Human
ggaaugcucaguucuuggugcuggagugugaggcagcgcccuccuggucuauucc

SEQ ID NO: 4195987 - RNA, 100 nt, Human
ggaaugcuuuaucaaacuuuaaggaucccgauuuucuagaaaacaaaagcaucuaugaggugcuagagaauugucuugagaguucauaggucaccauucc

SEQ ID NO: 4195988 - RNA, 81 nt, Human
ggaauggcugguccagaugccuuggcuuuauuaacucacuacacucacugguggagccuccucacacuguggccagacucc

SEQ ID NO: 4195989 - RNA, 62 nt, Human
ggaaugggagcuuggcagugucacuagggagccacacuuccucugccugugagcuuccaucc

SEQ ID NO: 4195990 - RNA, 57 nt, Human
ggaauggguagaggguauuuguuguuucacagagaacagcaaacucuucccaucuuc

SEQ ID NO: 4195991 - RNA, 82 nt, Human
ggaauguggaggaagggauucagaccaggugaucucugugggucucuugguggucugauauuuuuucuuaccuuugaauucc

SEQ ID NO: 4195992 - RNA, 79 nt, Human
ggaauguuucagaauaucgauucagugaacuucuguuguacaaagcuuuaucucauuguugauaugcugucugcauucc

SEQ ID NO: 4195993 - RNA, 78 nt, Human
ggaauuagaggauaaggauuuaaguuugcauuacucaguauaugagugugugaccuuuuaauuuaauuucccugaucc

SEQ ID NO: 4195994 - RNA, 95 nt, Human
ggaauuagccucuucgacuggggcggaguagcuggggugugagaaaagaacaccuucauacaacuuccagcuuucagccccuuggagagauuucc

SEQ ID NO: 4195995 - RNA, 77 nt, Human
ggaauuagcucucuaaaugcccuacaaugacuggcugccuugucaguccucugagggcgauuugaguaccuaacucc

SEQ ID NO: 4195996 - RNA, 70 nt, Human
ggaauuaggcagcauggauucugaauaccagccuuaucuuugguuuuugaaugugugugcuuuucuuuuc

SEQ ID NO: 4195997 - RNA, 90 nt, Human
ggaauuagugaaagaccuuagaauucacaggagguauuuguccuucacgcgaguguagaccaaacguaaccuaugaguuucuuuuauucc

SEQ ID NO: 4195998 - RNA, 71 nt, Human
ggaauucuucagaauaucuggcacugaaacauauuggcuucaauuaaaaggcuaugauuucugugaauucc

SEQ ID NO: 4195999 - RNA, 62 nt, Human
ggaauucuugaaugcuaugguucugauucuagaauucucagguucuacaguuuuagaauucc

SEQ ID NO: 4196000 - RNA, 78 nt, Human
ggaauugaaucauugagaugcugauugaauuguuguugaugguucaacaauuuugagaugagacagaucaaauuuucc

SEQ ID NO: 4196001 - RNA, 57 nt, Human
ggaauugcuuaucuuguugaauagggcauauuucucaagacauuaauaaguaguucu

SEQ ID NO: 4196002 - RNA, 56 nt, Human
ggaauugugauucaggcugcuccuuucccugguccccagcccuugauuuacaaucc

SEQ ID NO: 4196003 - RNA, 83 nt, Human
ggaauuuagagucccuggguuuuaccgagucuccacugacuagcagugcagcugugggagaaucucuggguuucugggacucc

SEQ ID NO: 4196004 - RNA, 77 nt, Human
ggaauuucgacgugauccacuuaaugcaugguagcagggccagagugaaauaggggaucaagcuguggggauaaucc

SEQ ID NO: 4196005 - RNA, 74 nt, Human
ggaauuugggucacaagguacuguaagaaaaauuaaacauuaguuuucaugaauuuccuugagaaacagguuuu

SEQ ID NO: 4196006 - RNA, 63 nt, Human
ggaauuuuaagcauaugacugguuuguaggguaagucauuaugagccaaugcuuaugaguuuc

SEQ ID NO: 4196007 - RNA, 72 nt, Human
ggaauuuugccugggcuaguaagccagaauaauacauuuuugcuugaacuuggcucuuaggaaaauaauuuc

SEQ ID NO: 4196008 - RNA, 103 nt, Human
ggacaaaacacacacacacacacacguauccacauauguauacauauguacacaaguacauacuuauguguauaugugugugugugugugugugugugugucc

SEQ ID NO: 4196009 - RNA, 74 nt, Human
ggacaaacaaagggauggagcccagcuguucuccagccucccugaggacaaaggguuccuccugugaacugucc

SEQ ID NO: 4196010 - RNA, 55 nt, Human
ggacaaagcaguauauugguaguuguuaauauagcagugcuagcucugccugucu

SEQ ID NO: 4196011 - RNA, 63 nt, Human
ggacaaaggguuguauauaauggguaaauuucuggcccaguuuaucugugauccuaaaugucu

SEQ ID NO: 4196012 - RNA, 64 nt, Human
ggacaaaugagcccuaauuuacaacaucuagucuuucuagaugcuaaggagguugccagugucu

SEQ ID NO: 4196013 - RNA, 61 nt, Human
ggacaacauguuuuaauuaaggaauguugaucaggcaauugugcuuuaaaaacauguuucc

SEQ ID NO: 4196014 - RNA, 56 nt, Human
ggacaagccugugaguggguuucacucaguggaaucccuccaagcaggucuuguuc

SEQ ID NO: 4196015 - RNA, 105 nt, Human
ggacaagggaauguauggcauuacaagucagaauaauguuucuuuugagaaaagaggauucaagagcugaacauuuuugacauguuuaucuauucaucuauguuu

SEQ ID NO: 4196016 - RNA, 82 nt, Human
ggacaauguggauucuuuagcccagaaaguuaaauaccuccaacuuuggcaguccugaccuucuggguagagaauauaguuc

SEQ ID NO: 4196017 - RNA, 59 nt, Human
ggacaauguuugcugcuaaggucaguacaguggacuauuuuguccuuagugcaggguuc

SEQ ID NO: 4196018 - RNA, 88 nt, Human
ggacaauuuguguaacaaggagcuuggggaauugacuucuuauuggcccagaaauuguaaauauucccucgguuccuacaacuuaucc

SEQ ID NO: 4196019 - RNA, 73 nt, Human
ggacacaggcacucauucagagagguggcagaguaauaacugaaaauguccccauaucaugaggccugaguuc

SEQ ID NO: 4196020 - RNA, 64 nt, Human
ggacaccuaccugggccuuucugccaugcggcaccauaaaaauaagagaugccugugggugucc

SEQ ID NO: 4196021 - RNA, 79 nt, Human
ggacacguccauguauuuuggggaaggccugggugucaugggauaaguucaguuguccccaaaauauacggacaugucc

SEQ ID NO: 4196022 - RNA, 64 nt, Human
ggacacugugcuagcugggcuuauccuucuuacugggauggcagaagcacaacacggcaagucc

SEQ ID NO: 4196023 - RNA, 74 nt, Human
ggacacuuuuugguauggcauagccauucugcuuaucaggggauguuagaacuggcggcuagaccacuguuuuc

SEQ ID NO: 4196024 - RNA, 78 nt, Human
gcugucuugccauuuguuuagcaaagucugaguugaucaauuuuaaauagcacuuccugaacacauuaagacuacagc

SEQ ID NO: 4196025 - RNA, 60 nt, Human
gcugucuuuccccugcuccagaucuuguuacuuuccuuuuggauuacugggcgggacagc

SEQ ID NO: 4196026 - RNA, 57 nt, Human
gcugucuuugcuaggaaagaggagaaauauucugcuuucagcugguaaagaaacagu

SEQ ID NO: 4196027 - RNA, 71 nt, Human
gcugugaaauguuaacaauagaguuucuucaggaucaaauucuguguagucacuauuuuaacaucuauagc

SEQ ID NO: 4196028 - RNA, 95 nt, Human
gcugugaacguugaacucccaccaguacagaugguagauguagaaggagaagucgucauccccacugcugcugguguaggagaggacguagcggc

SEQ ID NO: 4196029 - RNA, 128 nt, Human
gcugugacguagacccuaugacacgcuuauucaaaccccauagacaacuugcagcuaggaugaccccucagaguugucucaaaugggguuaaaauggcugaguguuuauacucugccccuucaucagu

SEQ ID NO: 4196030 - RNA, 60 nt, Human
gcugugagcaguguaaguacugggaguauugucaguguaaauguuuacauugcucgcagu

SEQ ID NO: 4196031 - RNA, 80 nt, Human
gcugugagcuguguguuucacccugacaccaacauuuuuuacauuuguuguuauaggugguacaagcaaaauuucacagc

SEQ ID NO: 4196032 - RNA, 130 nt, Human
gcugugagugaugagaagggaagaauugcacuggggccagcugaggccgugcaggcugcagaccacccccugcccagcucagcgacuccuuagucucccugccuucucuaagccucaucugaacagagac

SEQ ID NO: 4196033 - RNA, 126 nt, Human
gcugugauucugcuuuguggacuuuacacaagcugucacaauaucccaaucugccacagauguucuggguagcauugguuuuauugggugauaagggccacguggcagacucguacccacuauagc

SEQ ID NO: 4196034 - RNA, 62 nt, Human
gcugugcaucuucauucuggacccuggucuuugcuacaggggcucagugaugucugcagagu

SEQ ID NO: 4196035 - RNA, 67 nt, Human
gcugugccucagacggggccaucucccagguuucucuaccuggcccaggcauccuuuuggucacagc

SEQ ID NO: 4196036 - RNA, 84 nt, Human
gcugugcuacagcccccguuuuuaggaaauuggugcuuggcaaacgaugaaaaguuucacagaauaugaagguuauggcacagu

SEQ ID NO: 4196037 - RNA, 57 nt, Human
gcugugcucaacgugccuuccuccuauauauuugaggaagaggcacuuuauuacagu

SEQ ID NO: 4196038 - RNA, 65 nt, Human
gcugugcugauuauuagugucagguugguuguuugaagggcucauggcagggguaguaguacagc

SEQ ID NO: 4196039 - RNA, 67 nt, Human
gcugugcuuuugguagaucccaagcaaggacauaagguucccagcauggaauccccaagaaagcagc

SEQ ID NO: 4196040 - RNA, 57 nt, Human
gcuguggaugcuauggaucauccucuucaaaggcaauuuuuccuuggucucuauagc

SEQ ID NO: 4196041 - RNA, 55 nt, Human
gcuguggccgggcccaggccgccagggacgcuuugagacauggaccggccacagc

SEQ ID NO: 4196042 - RNA, 79 nt, Human
gcugugggccaggaggccucaguggcuccaggauaccagggggaccugcucccugcacucaggcccaccugccuauagc

SEQ ID NO: 4196043 - RNA, 87 nt, Human
gcuguggucaguuugugcuaggcacuauuucucaauuuccuuggcugguccucagagauacuguucugguuuacaagugucuguagu

SEQ ID NO: 4196044 - RNA, 72 nt, Human
ggagucugcgggugaagcuccugcaggggcccgcgauacagcagggcagcaggagcucgcuccacuggcucc

SEQ ID NO: 4196045 - RNA, 88 nt, Human
ggagucuggcucugccacccaggcuggagugcaguggcacgaucucugcucacugcaagcuccgccucccggguucacgccauucucc

SEQ ID NO: 4196046 - RNA, 61 nt, Human
ggagucuggguccgggggugaauugagcccgagcucagucccagugcuugccuuugcugcc

SEQ ID NO: 4196047 - RNA, 62 nt, Human
ggagucuguuuuacaugcaggacagggaucuuuucagcauguaguucagaucauguuauucc

SEQ ID NO: 4196048 - RNA, 87 nt, Human
ggagucuugcucugucaccaggcuagagugcaguggcgcuaucucagcucacugcaaccuccgccucccagguucaagcgauucucc

SEQ ID NO: 4196049 - RNA, 88 nt, Human
ggagucuugcucugucacccaggcuggagugcaggggcgcgaucucggcucacugcaaccucugccucccggguucaagugauucucc

SEQ ID NO: 4196050 - RNA, 88 nt, Human
ggagucuugcucugucaccgaggcuggagugcagugaaaugaucucggcucacugcaagcucuaccucccagguucaagcgauucuuc

SEQ ID NO: 4196051 - RNA, 88 nt, Human
ggagucuugcucugucgcccaggcuggagugcaguggcgcaaucuccgcucacugcaagcucugccaccuggguucacaccauucucc

SEQ ID NO: 4196052 - RNA, 90 nt, Human
ggagucuuguucuguccagcccaggcuggaguguagugacacgaucucagcucacugcaaccuccaccuccuggguucaaacaauucucc

SEQ ID NO: 4196053 - RNA, 88 nt, Human
ggagucuuucucugucacccaggcuggauugcaguggcaagaucucugcucaccgcaaccuccgccucccggguucaagagauucucc

SEQ ID NO: 4196054 - RNA, 120 nt, Human
ggagugaaaguucccaccacccuuucucuuacccgcuggggaguagggcuguauuguuaaggagccauggcgccacuagagggaaguauuggauagggaggaaaagaaacuucacauucc

SEQ ID NO: 4196055 - RNA, 56 nt, Human
ggagugaaguggcgcgaucucggcucacugcaagcuccgccucccggcuucacgcc

SEQ ID NO: 4196056 - RNA, 85 nt, Human
ggagugaggcccagagaagugaagugacuugcccaaggucaucuagccaggggguaaaggguucauuagcugggguucuuacucc

SEQ ID NO: 4196057 - RNA, 100 nt, Human
ggagugaggcgcaggcugugggugcaccaguggggcauccaccacggagaaugugggugcucccauguguggguacagacgccuggaggguccuggcucc

SEQ ID NO: 4196058 - RNA, 94 nt, Human
ggagugaguagguucucugacuucuucauccuugccauuggggugaccuaauuaccuggcaucggaaugagggacagaaaaguuucaccacucu

SEQ ID NO: 4196059 - RNA, 55 nt, Human
ggagugaugcuugcugccuccaaaaccuggagagcccuacaaggcguuuugcuuc

SEQ ID NO: 4196060 - RNA, 58 nt, Human
ggagugcaaagugcauggggaagggugcauguccuccauggcaggacuuugacaaucc

SEQ ID NO: 4196061 - RNA, 73 nt, Human
ggagugcaguggcaagaugacuacucacugccaccuccaacuucuaggcucgagagauccucuugccaccucc

SEQ ID NO: 4196062 - RNA, 55 nt, Human
ggagugcccugugaacuguaaggaauuucagucccuucauucacagaggcauauc

SEQ ID NO: 4196063 - RNA, 57 nt, Human
ggagugcuccaaauuuguaugaagaucaaggucacauauucaaaacuggaccacucu

SEQ ID NO: 4196064 - RNA, 83 nt, Human
ggagugcuugcaugaucaaugacagguuaucuaugaaaagcagugaauauaugauauucuaaauugacaccacaaguaccucc

SEQ ID NO: 4196065 - RNA, 77 nt, Human
ggaguggaagugauuguuccguugagugucuauugacccauuaaauacaccagauaagaacuaaucuuguucuaccc

SEQ ID NO: 4196066 - RNA, 83 nt, Human
ggaguggagccugguaaccgcgacuuccccgccauguucuguguguugcuggcuggagaagggugguugacaaacuccgaccc

SEQ ID NO: 4196067 - RNA, 88 nt, Human
ggaguggaugaaggcaacaaaagucaaauauagguuuuaaguggaaacuaagaauguucaacgcuuuuuugcucuuuuaucuuucucc

SEQ ID NO: 4196068 - RNA, 57 nt, Human
ggagugggaaagcugccuuguagaucccagaguuuacaagucuguugaucccaaacu

SEQ ID NO: 4196069 - RNA, 114 nt, Human
ggaguggggcaggcccuggacuggcuguguggccucaacuugucacuguucuuucucugagccucaguagacucaacugcaaguggggcuugucauucuuggccugcuugcuuc

SEQ ID NO: 4196070 - RNA, 82 nt, Human
ggagugggugggggugagaggcuggcugagcgcagcacccagucaugcuccucagugucuucucuuuccuaccuucccuucc

SEQ ID NO: 4196071 - RNA, 82 nt, Human
ggaguguugucugagagccagugugguaucugaagaacgugaguucuaaagucaggacaaccuguuuucagacacccacuuu

SEQ ID NO: 4196072 - RNA, 122 nt, Human
ggaguuaacggcagugacucacuuggggcauucacagcaggucagcugaaacucucccuugcuguauagagaauuuaguccugcugggcaugcgcccaagacugugagcugagguugauaac

SEQ ID NO: 4196073 - RNA, 59 nt, Human
ggaguuaaguagaugaaguuuuugguaaauaaccaggcuucaccagacucuuaaucucc

SEQ ID NO: 4196074 - RNA, 67 nt, Human
ggaguuagucauguaugaaggagcacauuucuacauaaaaauucuucuuaaauauuuggcugacucu

SEQ ID NO: 4196075 - RNA, 129 nt, Human
ggaguucuggcagcaggagggcugagccuggagccuccugggccuugcucugugauguggguagggagucaccagucaugagcacaggugcagggaccccagucuuucucucugcuuccuaaggucucc

SEQ ID NO: 4196076 - RNA, 83 nt, Human
ggaguucuggcaugcagucaaccaguaagggaauguuucacaacaguaauaaccccuuaccagcugggacugccccaugcucc

SEQ ID NO: 4196077 - RNA, 83 nt, Human
ggaguucuggucgugucacccaggcuggagugcaguggcguaaucuugcgcagccuccaccuucuggguucaagcgauucucc

SEQ ID NO: 4196078 - RNA, 92 nt, Human
ggaguugaaggaaagaaucaagugcaaugaauagcugcaauuacaaauuagguaauugggcauggaugcauuugcuuuacuuugcacacucu

SEQ ID NO: 4196079 - RNA, 71 nt, Human
ggaguuguuauagaauguaagaaugcaaagauugaauggucaaugugguauuuuggcauucuuccaaaucc

SEQ ID NO: 4196080 - RNA, 118 nt, Human
ggaguuuagggugaaggauuugaugguaaagcagcuuaaauuagagccugagaggaguccuuaaacaaauucuaauuagagcuggcaauuuuccaaaaauaauuuuuucuuuaauuuc

SEQ ID NO: 4196081 - RNA, 77 nt, Human
ggaguuucaauauuuuugggaaagugcuguagaugauugcuggguugggcaguguuucccagagauggaaagaaccc

SEQ ID NO: 4196082 - RNA, 89 nt, Human
ggaguuucacccuugucacccaggcuggagugcaguggcacaaucuuggcucacugcaaccuccaccuuccggguucaagagauucucc

SEQ ID NO: 4196083 - RNA, 89 nt, Human
ggaguuucacucuugacacccaggcuggagugcauuggcaugaucucagcucaaugcaaccuccgccucccagguucaagcaauucucc

SEQ ID NO: 4196084 - RNA, 85 nt, Human
ggaguuucacucuuguugcccaggcuggaguguaauggugugaucuccgcucaccgcaaccucugccggguucaagugauucucc

SEQ ID NO: 4196085 - RNA, 90 nt, Human
ggaguuucacucuuguugccgaggcuggagugcaguggcgcaaucucggcucacugcagccuccgccuuccagguucaaagcgauucucc

SEQ ID NO: 4196086 - RNA, 89 nt, Human
ggaguuucacucuuguugcucaggcuggcgugcaauggcaugaucucggcucacugcaaccuccgccuccuggguucaagcaguucucc

SEQ ID NO: 4196087 - RNA, 89 nt, Human
ggaguuucgcucuuauugccgaggcuggagugcaguggcgcaaucucagcucaccgcaaccuccaccucccggguucaagcgauucucc

SEQ ID NO: 4196088 - RNA, 89 nt, Human
ggaguuucgcucuuguugccuaggcuggaguguaguggcacaaucauggcucaccacaaccuccgccucccggauucaagcgauucucc

SEQ ID NO: 4196089 - RNA, 89 nt, Human
ggaguuucggucuuguugcccaggcuggagugccauggccugaucucggcucaccgcaaccucugccucccagguucaagcgauucucc

SEQ ID NO: 4196090 - RNA, 89 nt, Human
ggaguuucguucuuuuugccuaggcuggagugcaauggcacgauauuggcucauugcaaccuccgccucccagguucaagugauucucc

SEQ ID NO: 4196091 - RNA, 57 nt, Human
ggaguuucugucaucccguccccguggcaacgccccccgggaaugauggaagacuuc

SEQ ID NO: 4196092 - RNA, 76 nt, Human
ggaguuugaauuuuauucuaaguuuaaugccaucaauuagaggcuuuauuaagcaggguaaguaaauguagacucu

SEQ ID NO: 4196093 - RNA, 62 nt, Human
ggaguuugagaccagccuggccaaaauggcgaaaccagacuggccaacauggucucaucucu

SEQ ID NO: 4196094 - RNA, 62 nt, Human
ggagacccauccggaccccaucacugccugucuaagcagagccagguguagucucggaggcc

SEQ ID NO: 4196095 - RNA, 89 nt, Human
ggagacgaagagaggcaaacugaacacgaaagucuuucuuguugaguuuaagaaaaaaucuuuuucuucaguuguuauuuuuuguuucu

SEQ ID NO: 4196096 - RNA, 69 nt, Human
ggagacgauuucagguuuggacauaaagaauuuguaauuauguugagauguccagccugcuguuucucu

SEQ ID NO: 4196097 - RNA, 67 nt, Human
ggagacgcagugcauguggcacucuccagguggccacccucagccacucacaugcauauucguuucu

SEQ ID NO: 4196098 - RNA, 73 nt, Human
ggagacuagaggugugcaugauuuagcacuuuaguacacuuuaguguacauguacacauuaguauacauuucc

SEQ ID NO: 4196099 - RNA, 57 nt, Human
ggaccauggcuuuccaguccuccacucuccauuugaguguagacauaggucuggucu

SEQ ID NO: 4196100 - RNA, 57 nt, Human
ggaccauguguggagagucaguuacuucccucuguggggcugacccuuuuacauucc

SEQ ID NO: 4196101 - RNA, 121 nt, Human
ggacccagagggccugcuuuggccggggugaauucucuggcuucaguaggguucacuuccuuuccugacaguggcuucucuggggucaagagagagccugggccuaggagaucuagggucu

SEQ ID NO: 4196102 - RNA, 83 nt, Human
ggacccaucuuacagacuugugccuccuuggcuguccugccuggucagccccuuggaacacagggcuggcccuaaguuggucc

SEQ ID NO: 4196103 - RNA, 55 nt, Human
ggaccccgauugugccagugguuaacccuuuagcugcugcagcacagggaggucc

SEQ ID NO: 4196104 - RNA, 59 nt, Human
ggacccggccgggaacuggcaguagggaggcccccgcugcagucgccggccugggugcc

SEQ ID NO: 4196105 - RNA, 56 nt, Human
ggacccucccagcucacgcaccauggcuugaaacugcagcacagcuaggagggucc

SEQ ID NO: 4196106 - RNA, 58 nt, Human
ggacccugcuacugucugaaacacucguguauguccucagugcugccauggcagggcc

SEQ ID NO: 4196107 - RNA, 76 nt, Human
ggacccugucgcccugaaggccuguuugcugcacaucugccugcagagccaaaccucagggcccggugcagugucc

SEQ ID NO: 4196108 - RNA, 64 nt, Human
ggaccgaagcuuacaguuccacguagcagcucaucucacuguuaaggaaacugugggguuagcc

SEQ ID NO: 4196109 - RNA, 76 nt, Human
ggaccgcuggacggcacauaugcuuuggaaagggagcaccucccuuggcucugucgccguuuggaauaacuggucu

SEQ ID NO: 4196110 - RNA, 126 nt, Human
ggaccuaagcugguacucuguuacauuucaugagaggaggucaggcugaauugaagauaguauguucaccucaccacccuuaugguucuggcagcuuaaaccuagccuucauuuauuuuggcgucc

SEQ ID NO: 4196111 - RNA, 74 nt, Human
ggaccucacggccuccuuuguguuguccauggaagaccaacuuccgggcaacugaagggagguuuguagggucc

SEQ ID NO: 4196112 - RNA, 84 nt, Human
ggaccucccuuccccagcccauggccagaaccaagcuccacuccaagguggauguggcugccauggagccugggacugugguuu

SEQ ID NO: 4196113 - RNA, 57 nt, Human
ggaccucgaaacauagcaguucuaaacaaguaugugaacugcuggucuuuucugucu

SEQ ID NO: 4196114 - RNA, 107 nt, Human
ggaccucuaggggagucagaaucaguauaagagugaggaagggcauggccuacaugcuauaauauuuuuguucuauguauauuacuuuuugauguuccugaaaggcu

SEQ ID NO: 4196115 - RNA, 73 nt, Human
ggaccucucaggaucugauguugugaaaguuacuuucaaagguuaacaacuguuagacacuucuaaggggucu

SEQ ID NO: 4196116 - RNA, 55 nt, Human
ggaccuggcuucuauaccaccaggugucuugcacccaugaugucugaagucaucc

SEQ ID NO: 4196117 - RNA, 56 nt, Human
ggaccuguucuaaucuuggggcagagaagacucucaguaugacuagagcaggggcc

SEQ ID NO: 4196118 - RNA, 70 nt, Human
ggaccuugguauagcauuagcccucaggaaauggauccucugagguguugaugaccuaugcaaaaaggcc

SEQ ID NO: 4196119 - RNA, 98 nt, Human
ggacgacuagccacucccuggggugaggcagcugagcacagcuggugucugccagaggccaggcugccugacugcccaacugggaagggcuugucucc

SEQ ID NO: 4196120 - RNA, 64 nt, Human
ggacgccugcucucacuggacagcugcucucacuggacagcugcucucacuggacgccugcucu

SEQ ID NO: 4196121 - RNA, 58 nt, Human
ggacgcuggcuccgccuuccccauuuaugcagcuccuggggagacagggccagugucc

SEQ ID NO: 4196122 - RNA, 128 nt, Human
ggacggaggaguuuccagguaguagaacucagugcaaauauugggacagucuagaaaauuaggagaguuaucuccccuauggcaaugcccaauguuguacagcgcuaacaaucuuuuuuuuuuuuucc

SEQ ID NO: 4196123 - RNA, 79 nt, Human
ggacggugcaggcuaagugagcuggcuaggaguucgggugccuggcuucucucccuggcacucagaccugcacccaucc

SEQ ID NO: 4196124 - RNA, 94 nt, Human
ggacguuaguaccuuggaaugccuuggcucaggccaccuugucuuccaaagcacacaagaugugucucaucagggugucaaggugccagcguuc

SEQ ID NO: 4196125 - RNA, 113 nt, Human
ggacuaagugaagcucugcagugcacugaacaggcccuccugcucaaaauaccaguagcagaacagacuuaacagggcuguucagugcaccgcagagcuucauuuccuggucc

SEQ ID NO: 4196126 - RNA, 73 nt, Human
ggacuagauguguagagggaauuucaaauaauguauuuaaaaaauuauuugaagucuguuuuauacuuauuuc

SEQ ID NO: 4196127 - RNA, 129 nt, Human
ggacuagguagaagacagaggggaaagucauaaaaacaaugcuggucugcagaguugggagcccuggauuuuagcuccagcccugcacugauuagauaauuuugagaagucacuuugccauccugaucc

SEQ ID NO: 4196128 - RNA, 86 nt, Human
ggacuaucugaacauuuauugcuuaaaaaauaugugaguuugugagcuuaucccagcauuuaggcaguaagugacaagauaugucc

SEQ ID NO: 4196129 - RNA, 76 nt, Human
ggacuaucugugccuucucccagacuuagcaacuuauguuagagcucuguggagagagaacugcuugcagauguuc

SEQ ID NO: 4196130 - RNA, 78 nt, Human
ggacuaugccuucucucugcggccuuagcgggggcugagggcuccaaggaaccugcagcuguaggagaaggcgcgucc

SEQ ID NO: 4196131 - RNA, 67 nt, Human
ggacuauuggcuauguuucgaugaacagauucaacaugauaaaauauaugaacaugaccaauagucc

SEQ ID NO: 4196132 - RNA, 60 nt, Human
ggacucagcccagcccagcaagugcagccgcuuucagcuccgccucuggcuggguucucc

SEQ ID NO: 4196133 - RNA, 79 nt, Human
ggacucccagagaccccgcugcccuucugagcugcugcuuuccaacuuaggaauugcccgugggguccucacggagucc

SEQ ID NO: 4196134 - RNA, 90 nt, Human
ggacucccuaaucugcugagcccaucuugauuguauuucugcugcccuuucacagucccuaguggagcucacagucccuagugguuuucc

SEQ ID NO: 4196135 - RNA, 58 nt, Human
ggacucccuugacuagguguaaggaugugcucuugagaugcugggaacaaggaagucc

SEQ ID NO: 4196136 - RNA, 69 nt, Human
ggacucucuggagucuuauccccagcccccagguggauaaugagaacugggagacuccagaacugaucc

SEQ ID NO: 4196137 - RNA, 61 nt, Human
ggacucugccuuuguggucgggagaaugauaguuucuccauuuuacagauaaggcagcucc

SEQ ID NO: 4196138 - RNA, 62 nt, Human
ggacucugcucuguccugaaaaccuggaaucauaacauuucauggcuaggacuagagugucc

SEQ ID NO: 4196139 - RNA, 64 nt, Human
ggacucugcugguuuuguucacugcuguauccccggagcccagaacagugcuuaguagauguuc

SEQ ID NO: 4196140 - RNA, 64 nt, Human
ggacugaaaucuuuccaugucagugccccauguaggaguauuuaauggaguagaauugcaguuu

SEQ ID NO: 4196141 - RNA, 64 nt, Human
ggacugaacacuuaaauguccagaaaaauguggaaguugggcauucuuagggaagugcaggucc

SEQ ID NO: 4196142 - RNA, 90 nt, Human
ggacugaaccugagucuuuugauuugcuuuucacagcuacuugaugcugccauggggauuguaaaccagaaaacucaacaggucaggucu

SEQ ID NO: 4196143 - RNA, 55 nt, Human
ggacugaagccaugugcucacugguacaaaaaccaggaagcuauaguguuagcuc

SEQ ID NO: 4196144 - RNA, 55 nt, Human
ggacugagacggcuccaaguguccucagaguggggcagaaaggaaucuuaggucc

SEQ ID NO: 4196145 - RNA, 61 nt, Human
ggacugccguuacaaacacacaaacuuggugauuucauagaaguuuguucuuguauagucu

SEQ ID NO: 4196146 - RNA, 59 nt, Human
ggacugcuccagugugauuugucuucaucacccaagugugagucucacccaagcagucu

SEQ ID NO: 4196147 - RNA, 124 nt, Human
ggacuggagagacugagauucagagacaaugucucugcuuguggaucacccuggccaugucacaagccuguuagauguugugcucucuccacuauaaucacaaauaucagaacucucucugucu

SEQ ID NO: 4196148 - RNA, 71 nt, Human
ggacuggauuuuguuugacugauguuuguuuauucauucaacaaacauguaccuacaaucagaauccaucu

SEQ ID NO: 4196149 - RNA, 67 nt, Human
ggacuggccaggcagcaguagcuuuccccugcuggggauccgggcccugggcugccuugggcauucc

SEQ ID NO: 4196150 - RNA, 87 nt, Human
ggacugggaaggcaugcauaguuuuucuagaaggguuuuuaaguuccuccccacccagagguccugugaugcugcaccucgcugucc

SEQ ID NO: 4196151 - RNA, 64 nt, Human
ggacugggagaauggaggcaagaaaagggcauaguuugacucccucugugucucuucccaguuc

SEQ ID NO: 4196152 - RNA, 58 nt, Human
ggacugggccagggguuggacucugugcaggacgcugagucacccguggaccagcucc

SEQ ID NO: 4196153 - RNA, 87 nt, Human
ggacugggucuggaaacugcggaaggcagcgcaggguggaaguguucggacucagcccuggccucuucgcuuuccagcaccagcucc

SEQ ID NO: 4196154 - RNA, 87 nt, Human
ggacuggugggagcuucauggagcuguagggagcaguggucaaguguucuacugacucaaguuccaucagcaguuucccaguagucc

SEQ ID NO: 4196155 - RNA, 57 nt, Human
ggacugucagcuuggugagggaauccagaugaauuucccuuuucaagccaucaguuu

SEQ ID NO: 4196156 - RNA, 72 nt, Human
ggacuucuuauggcuguagucuggaagugaugcauauaauugccauucacaguucauuagcuguaaguagcc

SEQ ID NO: 4196157 - RNA, 89 nt, Human
ggacuugagagcucccugugguuuacucuguggcuagaaaacacugccggccagauggaucacaaaugucuaugguagcuuagaagcuc

SEQ ID NO: 4196158 - RNA, 79 nt, Human
ggacuugauguaaagugauucaugggagaaguucuacucauguccuaagcucauccuaugugucaagauauuaauuucc

SEQ ID NO: 4196159 - RNA, 85 nt, Human
ggacuugauucaugaaaauguauuugcauccugaugauacuuuuucaguugucuagauucauauauuuuuggagaagcugagucc

SEQ ID NO: 4196160 - RNA, 78 nt, Human
ggacuugugacugugaccuuauuggaaauggagucuuuacagauggucaaguuaagauaaggugaucagggcaggucc

SEQ ID NO: 4196161 - RNA, 55 nt, Human
ggacuuguuaucugugccacgggguuuagccuugcugucucaugggugcuagucc

SEQ ID NO: 4196162 - RNA, 93 nt, Human
ggacuuucuguuagggcagcacaaggcauggacucaauccuauaggucagcauccagauccccaguccucugcugugcgucuuuggaaaguuu

SEQ ID NO: 4196163 - RNA, 83 nt, Human
ggacuuugcuucuuggaauucuguggcugacccuuuucacucuucccugauuccgcagacaaagaaaccguagaagcaagucc

SEQ ID NO: 4196164 - RNA, 55 nt, Human
ggagaaaaggcugcuuacucagcucccucugcuccaagucacagaccuugucucc

SEQ ID NO: 4196165 - RNA, 60 nt, Human
ggagaaaauugaaucaguagcugauguggaaguauuuugcuagcuuguucaauuucaucc

SEQ ID NO: 4196166 - RNA, 63 nt, Human
ggagaaacucagugaauuuucaucaaauuggauagagcccagcagugauuuuacugaaucucc

SEQ ID NO: 4196167 - RNA, 81 nt, Human
ggagaaacuugccugccaggcaaccugggagucuuaaucugaucagaccucacucuuguccuggcaggucuagucccugcc

SEQ ID NO: 4196168 - RNA, 73 nt, Human
ggaaagaaagauaugaugggcaggauuuuaaguugaaucucaaugaccccuguuccugucaaauuuucuuccc

SEQ ID NO: 4196169 - RNA, 83 nt, Human
ggaaagaauggaaagucuucacggcacuaguguucagcuucuagguuuacauguggucaaucuguguaggaugaauucuuucu

SEQ ID NO: 4196170 - RNA, 56 nt, Human
ggaaagacauuagcuuagaugucagcaagcuaagucucuuagagcuauguuuaucc

SEQ ID NO: 4196171 - RNA, 59 nt, Human
ggaaagagcccagcagugcuugccacuuucuuagacugagaaguaaggugggcucuucc

SEQ ID NO: 4196172 - RNA, 77 nt, Human
ggaaagaguaugggagcuuuacucuguucagaaaggagaauuuauggaaguauagcucacaaucuaugaucugcacc

SEQ ID NO: 4196173 - RNA, 72 nt, Human
ggaaagauaaguagggcaauuugugggagccuguacacuauuuaacuucccagggagugcuacuaucaagcc

SEQ ID NO: 4196174 - RNA, 90 nt, Human
ggaaagauugcucuaucacagugaugggauccuagcauguuauaaaucgaagauuguucuuuccugccacugagaugagcagcucuuucu

SEQ ID NO: 4196175 - RNA, 90 nt, Human
ggaaagcaaguggggccauugaggugggcagagggagauguuuauuuucugcauucuucugccuacuuucauccauccacuuacccagcc

SEQ ID NO: 4196176 - RNA, 73 nt, Human
ggaaagccugccugggucacccaaaagggccaggccauccuguuuaccugguggguaaucugguggguucucc

SEQ ID NO: 4196177 - RNA, 78 nt, Human
ggaaaggaagaagcauucuuucauugguugguguguauugccuugucaaccaauaagaggaugccauuuauccuuuuc

SEQ ID NO: 4196178 - RNA, 57 nt, Human
ggaggggccucugcuccacaggaucacucagggacccaggcuggcagaggcuccucc

SEQ ID NO: 4196179 - RNA, 76 nt, Human
ggaggggcguagacuuaacauccuguuuaaauuuggcauuagccgaauuuuuuaacagggguuaugaccccccucc

SEQ ID NO: 4196180 - RNA, 68 nt, Human
ggaggggcuuaggacccagcccauggaggcugaauggggcugcaaagggcauggccugagcacuuuuc

SEQ ID NO: 4196181 - RNA, 102 nt, Human
ggagggggcaggagggccgggggaggccgcgaagggccugcucgcaaaccguuauaguccuucagcaccucccucggccgguggcccuccuagccugccucc

SEQ ID NO: 4196182 - RNA, 70 nt, Human
ggaggggguggugccacguguggcucuguggacggcuccgacgacccugacagugugcuucucucccucc

SEQ ID NO: 4196183 - RNA, 104 nt, Human
ggaggguauguggaaaggguaacagcaugacccaaccuauguccuuggcauccucacucaaccaggcaauagguuccucaucuuugacccuuuggaugccuucc

SEQ ID NO: 4196184 - RNA, 81 nt, Human
ggagggucuuuacagagaacucauagaaagaaagagugcugcgauauuccuucuucccuuucugcagguucuuuuuucucc

SEQ ID NO: 4196185 - RNA, 60 nt, Human
ggaggguggcagcguccugggcuccaugcacuuggccaaagaggacuucugaacccgucc

SEQ ID NO: 4196186 - RNA, 102 nt, Human
ggaggguguggggcugcagggcugcuccaaggcucuggugcugaggcgucucacugccuccaccaugugcuuuggcuuuggcuaucagcugggacacccucc

SEQ ID NO: 4196187 - RNA, 78 nt, Human
ggaggguucgugcagcagcuguugacugguacaugaagcauucuuuuauguuuguugaagcugaugauugacaucucc

SEQ ID NO: 4196188 - RNA, 117 nt, Human
ggaggguugagcuuccaugugaccagccaggccucaggagcagggaccugcuggaccccagccugccacuggcccggggauccuggcagugggaagcuggaaguccauucagacucc

SEQ ID NO: 4196189 - RNA, 70 nt, Human
ggagguagagagugcggacugugucuuacaagcaggcaaagccgaggcaaggccgcacgucucagccuuc

SEQ ID NO: 4196190 - RNA, 118 nt, Human
ggagguagaugacaaggccacaaaauccucagggagcuagcuucuuccagguuucuacucugccauuccuagggagccuggucagguuggcuccuggaucucaccaucacugcauucc

SEQ ID NO: 4196191 - RNA, 83 nt, Human
ggagguaggagugugcagggcugccugugccgauggacuuuguacuuugcaucgguauggacccgucuuguuacccuuccuuc

SEQ ID NO: 4196192 - RNA, 94 nt, Human
ggagguauuuaauaaacaggugcagcugaaugugugugguuaaagugcaauccaguaguuauuuauuuguccagauuguuuauaaccugcuucc

SEQ ID NO: 4196193 - RNA, 63 nt, Human
ggaggucaagggugccucaugucauccaacccaggagggcuuuggagcugccacuuguccucc

SEQ ID NO: 4196194 - RNA, 63 nt, Human
ggagguccuguccugggaugguccuuccugguggggaggggucuauccugagaugguccuucc

SEQ ID NO: 4196195 - RNA, 66 nt, Human
ggaggucguguuucugagcagcagaauacucucccuguccugguguuuaucugacugccuaccucc

SEQ ID NO: 4196196 - RNA, 56 nt, Human
ggaggucugagucuauauacauugaggagauagucaacacaugauucauggcuucc

SEQ ID NO: 4196197 - RNA, 92 nt, Human
ggaggucuugaucugauuguagguguuucaugauuugguaugcacacacauacucucucacacacgccuauauagaauugucaugaauaucc

SEQ ID NO: 4196198 - RNA, 70 nt, Human
ggaggugaggccguaggguguggggugggugguacaccugcucccugucacccuccgaguccucccuucc

SEQ ID NO: 4196199 - RNA, 71 nt, Human
ggaggugauucaggccugcaucucagcaaaacuacaaauugcugcaugucacaggcccugagauaaccccc

SEQ ID NO: 4196200 - RNA, 80 nt, Human
ggaggugauugaaaggacuguuuuuucuucuagggcccuuuguugguaagagaagauugaaagaguccauuguuuccucc

SEQ ID NO: 4196201 - RNA, 74 nt, Human
ggagguggaaagcuaguuuuucuuaguuuuaaaucauuaaggguuuauaucuggaguugcuaggagcuauuuuc

SEQ ID NO: 4196202 - RNA, 69 nt, Human
ggagguggaagccuucagaacagcaucccugggaauuugcaugcugcuguugacggcuguccagccucc

SEQ ID NO: 4196203 - RNA, 70 nt, Human
ggagguggcaggaucacuugaguccagaaguuugagacuagccuggacaacauagugagaccucaucucu

SEQ ID NO: 4196204 - RNA, 57 nt, Human
ggagguggcagggaacauaauuucuguuugaaaguucuuuuguuuucugcuaccuuu

SEQ ID NO: 4196205 - RNA, 56 nt, Human
ggaggugggagacauaggcggcagggucggaggcgcgcacaguguucgccaccucc

SEQ ID NO: 4196206 - RNA, 56 nt, Human
ggaggugggaugugugugcuacuggcaucuaguggcugcuaaacauccuacacugc

SEQ ID NO: 4196207 - RNA, 75 nt, Human
ggagguuaagagcuucccuguuguagaggcuacuccaguuuuugcccuugauggggguaagcuaaagcugcuucc

SEQ ID NO: 4196208 - RNA, 86 nt, Human
ggagguuagugcagugaguggcagagcagggaaugagcucagguugcaggucccuggcuuggcacucuccacugcccuauggcucc

SEQ ID NO: 4196209 - RNA, 62 nt, Human
ggagguuucuggggaaguuuugcuuuuggauaaaagaaacaagggcacugaggaaaaccucu

SEQ ID NO: 4196210 - RNA, 88 nt, Human
ggagguuugagaaguaacaggcaugugaaugaccuaugagaaugggcaugaaauuugaaggucuuugcaucgcuuguuauuuaccacc

SEQ ID NO: 4196211 - RNA, 63 nt, Human
ggagguuuguggccagagauuaaauagaguccuuccucgaccuuucgaucucaggcugauccc

SEQ ID NO: 4196212 - RNA, 95 nt, Human
ggagguuuuuccaaucaucugaucuuguggaggcaccagcuaaugggagucuggcugccugaaugcaagacagccaauuauaugauucuuccucc

SEQ ID NO: 4196213 - RNA, 89 nt, Human
ggaguaaagcacuuuuacauguaggugacauuuuaauauagugcaaagaacuguauguuaggaagacacuuaccauggggcuuuaagcc

SEQ ID NO: 4196214 - RNA, 84 nt, Human
ggaguaaaugguguuuaucguucuggauugucugacaguuugucacacaggagucuccagguaugacaggccacuccugacuuc

SEQ ID NO: 4196215 - RNA, 63 nt, Human
ggaguaaauguguguuugugugugugggucuguguguguauaaacacugauggauauuuuucc

SEQ ID NO: 4196216 - RNA, 57 nt, Human
ggaguagauucugggaagauggcuacaggggcagcaacaucauuuuaaaaucucucc

SEQ ID NO: 4196217 - RNA, 60 nt, Human
ggaguaggaaagggacagucuaacaaggcagaaaauucuagacaguaacucuucuacucc

SEQ ID NO: 4196218 - RNA, 62 nt, Human
ggaguagguucucucagcaucccaccacguugcugguguggcagugugaccgagcuugcuuc

SEQ ID NO: 4196219 - RNA, 64 nt, Human
ggaguauaaaguguagggagcauuuucaaauuuuauuuauugacaacuuugcauuuuauucucc

SEQ ID NO: 4196220 - RNA, 85 nt, Human
ggagucaaagugggugcccugaugcuccaagaacuccucagggguggcgcagaggguagagcacucaggacacucauagggcucc

SEQ ID NO: 4196221 - RNA, 67 nt, Human
ggagucacaguuucccugagagagcugagggcauaaacaaugauaaguucuccaggggauggacuuc

SEQ ID NO: 4196222 - RNA, 55 nt, Human
ggagucaggcuagaggugagucugggauaagaacccuaguuugccaccagauucc

SEQ ID NO: 4196223 - RNA, 88 nt, Human
ggagucaugaagcaaauggagugaagagcuggaguuugaaucuggauuuuccaacucucuguuuuaugugcuuccugaucauggcuuc

SEQ ID NO: 4196224 - RNA, 56 nt, Human
ggagucaugagcaguuagugucagcucaggagcagccacaacuguccacaugcucc

SEQ ID NO: 4196225 - RNA, 56 nt, Human
ggaguccugaacagcuguugugugcccagugccaggcaaaugcuguggagggcucc

SEQ ID NO: 4196226 - RNA, 114 nt, Human
ggagucgggaucuucugggcugggggcuuggcccggucugguuuuuugcuccccuuaauggugcugaugagcuggguuuaggaaccacuugcccgagucucagauuuuggcucc

SEQ ID NO: 4196227 - RNA, 60 nt, Human
ggagucucacagcaaggagguaagguagcagauugccccucacuaaggcugugguucucu

SEQ ID NO: 4196228 - RNA, 87 nt, Human
ggagucucacucugucgccaggcuggagugcaguggugcaaucuuggcucacugcaaccuccgccugcuggguucaagugauucucc

SEQ ID NO: 4196229 - RNA, 58 nt, Human
ggagucucaggcuggaaugcaguggggcgaucucggcucacugcaaacuccgccuucc

SEQ ID NO: 4196230 - RNA, 88 nt, Human
ggagucucagucuuuugcccaggguggagugcaguggcaugaucucggcucacugcaaccuccaccucccggguucaagcgauucucc

SEQ ID NO: 4196231 - RNA, 88 nt, Human
ggagucucgcucugucacccaggcuggagugcaguggcgcgaucucggcucacugcaagcuccgccucccggguucacgccauucucc

SEQ ID NO: 4196232 - RNA, 88 nt, Human
ggagucucgcucugucacccaggcuggauugcaguggcaugaucucagcacacugcaagcucugccucccggguucgagugauucucc

SEQ ID NO: 4196233 - RNA, 88 nt, Human
ggagucucgcucugucgcccaggcuggagugcaguggugcuaucuugguucacugcaaccuccgccucccagguucaagcgauucucc

SEQ ID NO: 4196234 - RNA, 88 nt, Human
ggagucucgcugugucacccaggcuggagugcagugacucaaucucggcucucugcaaccucugccucccagguucaagcgauucucc

SEQ ID NO: 4196235 - RNA, 66 nt, Human
ggagucucugcuggggguuccuucacuguaugugcugaccauggagagcccauuggcagggguacc

SEQ ID NO: 4196236 - RNA, 88 nt, Human
ggagucuggcucuguugcccaggcuggagugcaguggugugaucucggcucacugcaagcuccaccucccggguucaugccauucucc

SEQ ID NO: 4196237 - RNA, 88 nt, Human
ggagucuugcucugucacccaggcuggagugcaguggcgugaucucagcucacugcaaccuccgccucccggguucaagccauucucc

SEQ ID NO: 4196238 - RNA, 89 nt, Human
ggagucuugcucuguugcccaggcuuggagggcaguggcaugaucucggcucacugcaaccucugccucccagguucaagcgauucucc

SEQ ID NO: 4196239 - RNA, 89 nt, Human
ggagucuugcucuuguugccuaggcuggaguguaguggcgcgaucucggcucauugcaaacuccgccucugggguucaagagauucuuc

SEQ ID NO: 4196240 - RNA, 88 nt, Human
ggagucuugcuuugucacccaggcuggauugcaguggcaugaucucgacucacugcaaccucugccucccgggugcaagcaauucucc

SEQ ID NO: 4196241 - RNA, 59 nt, Human
ggcagaggccagguccagaguuugugguaugaucggccaggcuaaggagcuugccagcc

SEQ ID NO: 4196242 - RNA, 76 nt, Human
ggcagaggcggguggaucacuugaggucaggaguuggaaaccagccuggccaacguggugaaaccccgccucuacu

SEQ ID NO: 4196243 - RNA, 55 nt, Human
ggcagagucagaggugguucugggccaaacacuaggagaagccucagaauuugcc

SEQ ID NO: 4196244 - RNA, 56 nt, Human
ggcagagucucccuguguugcccugguuucaaacuugggccaagugauucucugcc

SEQ ID NO: 4196245 - RNA, 77 nt, Human
ggcagaguggagaaagcauuuagugauggaagacucauaacucuaauuaacuacugcuuacuccaugaucucugacc

SEQ ID NO: 4196246 - RNA, 61 nt, Human
ggcagauaaacaauguuguauaggaacuucaacacacacuguacaauauucccacuuugcu

SEQ ID NO: 4196247 - RNA, 55 nt, Human
ggcagauggaaugagcugucuaccaggcgaauggugguugccaugcucucugacu

SEQ ID NO: 4196248 - RNA, 59 nt, Human
ggcagauuccaagagccugagaagcgcuguuccugccucucaggcucuuggaaccuguu

SEQ ID NO: 4196249 - RNA, 68 nt, Human
ggcagauuccuagauucuacucuagauccaugggaucagcauccuguagugggagccagggaucuacc

SEQ ID NO: 4196250 - RNA, 77 nt, Human
ggcagauugggcuggugccuccaucucaguuagauugcuuucuugccucaugcagauuuggagguauuucugcugcc

SEQ ID NO: 4196251 - RNA, 106 nt, Human
ggcagauuucaaagguugcaaagcuuaaggccagacucuggaaugacaaauuccuauaugucaucuacccguuaggcuuuaagaaagccagcugacuagccugacc

SEQ ID NO: 4196252 - RNA, 83 nt, Human
ggcagcaacuauuugguaguccugauaagauuauaggaucauaaucuaggaaacaggauuauaaaaucuuaacaaguugagcu

SEQ ID NO: 4196253 - RNA, 61 nt, Human
ggcagcaacucauuauuccuguaaauuuccagguaaagaaaucaauggcuggguuguugcc

SEQ ID NO: 4196254 - RNA, 78 nt, Human
ggcagcacauuuuaacuaauguuuuucugaauguucuaauuccagauaaauucaaagcauuuaggacucaugucugcc

SEQ ID NO: 4196255 - RNA, 77 nt, Human
ggcagcacuuaacaaugaguccucugagguuagaggauuuccaggcucuguuagaggauuauuguucuauuuaugcu

SEQ ID NO: 4196256 - RNA, 63 nt, Human
ggcagcacuuggugccauugagugguugcagcucucagauggcucugagguguccaguuugcc

SEQ ID NO: 4196257 - RNA, 59 nt, Human
ggcagcagcucagucucucaguagguuaacaagaauuuacugaguaucaguuguaugcc

SEQ ID NO: 4196258 - RNA, 61 nt, Human
ggcagcaggauaugguggagagagcgagucuucugaguuaaauccuggcauucuugcagcc

SEQ ID NO: 4196259 - RNA, 73 nt, Human
ggcagcaggauggccaauugccaucaauuucugcagcaagucuggcaucauggcaucuuggcaucuugcugcu

SEQ ID NO: 4196260 - RNA, 70 nt, Human
ggcagcagguuguuuuguggccagguuuggcaaaguggcuuccuggcagcuagaaggcagccugucugcc

SEQ ID NO: 4196261 - RNA, 58 nt, Human
ggcagcaucucauaucuucaggucuggaucccugaggcacucacaucugggagcugcc

SEQ ID NO: 4196262 - RNA, 76 nt, Human
ggcagccaggcugaggggcgagggacccuguguccuggacaggcuccaugguucucccucagagccugggauggcc

SEQ ID NO: 4196263 - RNA, 55 nt, Human
ggcagccaugcacgcugccugggagaagacaacuccaggcagugcaucuucuguc

SEQ ID NO: 4196264 - RNA, 58 nt, Human
ggcagcccaggucuggcccagccuggccggaaugcccuggggcaagaucugggugacc

SEQ ID NO: 4196265 - RNA, 72 nt, Human
ggcagccccuuucuccugugaggucagaaguuguuagguuuagcugaagcugcagcaggaggaagggugguc

SEQ ID NO: 4196266 - RNA, 129 nt, Human
ggcagcccgcaaccaccuuuagcucugggccccccaggccagccuggagcauggcuggguggggccaccagcccaugcucucaggcgggccugugaucuuucccagggcacauggacuguaggcuggcc

SEQ ID NO: 4196267 - RNA, 65 nt, Human
ggcagcccucgcuagcucucccccaugcacauccugggguugagcucuccgggagggcacuggcc

SEQ ID NO: 4196268 - RNA, 64 nt, Human
ggcagccuccagggcacugguguuuucuuugcagaaggugauaauccaugagugucugaggccc

SEQ ID NO: 4196269 - RNA, 81 nt, Human
ggcagccuccccagacagcgggaggccugggaauuugggccuagaacaaagccucucugcugggagcacaaacaggcugcc

SEQ ID NO: 4196270 - RNA, 75 nt, Human
ggcagccuccuaguucucugccagucgcugaaggacacccaggacaguuauugagugcagagcagggcugcugcu

SEQ ID NO: 4196271 - RNA, 66 nt, Human
ggcagccuuagcaggucccugcagccuaagcgugcugucagggccacccucugcugggugcugacc

SEQ ID NO: 4196272 - RNA, 80 nt, Human
ggcagccuuucugguucucuggcagaggugcuguuuaaaugacauuuuucuugaagaucagagagcuguugagagcugcc

SEQ ID NO: 4196273 - RNA, 112 nt, Human
ggcagcggcagcagcagcagcagcagccucugcacgggcacggguggcguugguuuugugugucugcuguuuguuagggguccagccugucuguugcugcugucuguguguc

SEQ ID NO: 4196274 - RNA, 57 nt, Human
ggcagcguucccagcagaggaagcccaggaacuguggcagucucacuggagggcucc

SEQ ID NO: 4196275 - RNA, 63 nt, Human
ggcagcuagaauugugaugcugcacacaagcaucuagacagcacauaccacaauaucguugcc

SEQ ID NO: 4196276 - RNA, 129 nt, Human
ggcagcucaauuccaugacaagagcaauggggcuuggaauugagaaacuacagcuuaccucuaucaaguuacuuaaaaauucuaagccccaguuccuauuuuuguaaacuaaggacaacaagagcuacc

SEQ ID NO: 4196277 - RNA, 58 nt, Human
ggcagcucccagcaacucacugagaacuggaaaguuuccaggaaggguugggaggguc

SEQ ID NO: 4196278 - RNA, 70 nt, Human
ggcagcuccccucuguggggcaguaucugguccugugccccagcugccaaaggagagugggggccaugcc

SEQ ID NO: 4196279 - RNA, 61 nt, Human
ggcagcucccuauggugaggcgacaguaguuugguuccuucuuuuucagggauagcgugcc

SEQ ID NO: 4196280 - RNA, 58 nt, Human
ggcagcugagcgugaggaagaguuucagcuugaauucugacucgaccacucagccacc

SEQ ID NO: 4196281 - RNA, 58 nt, Human
ggcagcugccgugagcucacgccccgaaauagccccaggggccccagccgcagcugcc

SEQ ID NO: 4196282 - RNA, 106 nt, Human
ggcagcugcgauugugggaagcaguuccuugagaaugguugcuucagcacccaaggcugagaugguagcaggcacuucauaggguuccuucagauuugcagaagcu

SEQ ID NO: 4196283 - RNA, 61 nt, Human
ggcagcugggucacaccgaucuguguuugggaaagaccggaguuggauuguacuugcugcu

SEQ ID NO: 4196284 - RNA, 71 nt, Human
ggcagcugucucugaguuagcagcaucaggaagccuccccuggaagacacuggcugcaggaugaggcugcc

SEQ ID NO: 4196285 - RNA, 55 nt, Human
ggcagcuguggugcugagauaggagcuuggaaugcuccauggugccaagacuguc

SEQ ID NO: 4196286 - RNA, 59 nt, Human
ggcagcuucggacggcuuauaauugguuccaguuaaucucugccgcccugagaacugcc

SEQ ID NO: 4196287 - RNA, 69 nt, Human
ggcagcuucucggcugggaguauuugaauaugaguuaaaacuacaaaguaacuccucguuagaacuguu

SEQ ID NO: 4196288 - RNA, 93 nt, Human
ggcagcuugcugacaaugcagauucccaggccccagaccagcuguauccaaauuuaggugcugccuaggaaucuguauuuucaacaagucucc

SEQ ID NO: 4196289 - RNA, 58 nt, Human
ggcagcuuucaccugucuuccucagugaaaacucugugagggcagagcugggcuugcc

SEQ ID NO: 4196290 - RNA, 60 nt, Human
ggcagcuuucuguuuagucuggcagugaccaaacgggccugcaagaaucaggaagcugcc

SEQ ID NO: 4196291 - RNA, 69 nt, Human
ggcaggacuggcgugaagguggccaugaggaguuaacucugccuuauucuaugucuucugccaccugcc

SEQ ID NO: 4196292 - RNA, 56 nt, Human
ggcaggagaaaggucucuucuuuagagaagaggaagggaaagagacccauccuguc

SEQ ID NO: 4196293 - RNA, 57 nt, Human
ggcaggagaaucgcuggaagcaaggagguggagauugcagccagccgagaccaugcc

SEQ ID NO: 4196294 - RNA, 56 nt, Human
ggcaggagcucagguugguuccccacauuuucgggcuuacucugacguguccugcu

SEQ ID NO: 4196295 - RNA, 84 nt, Human
ggcaggaggagggggucucuuuaucagugaacacgggagcagcaugagaaguucaaagaauuuugagaccugacuccacuugcc

SEQ ID NO: 4196296 - RNA, 62 nt, Human
ggcaggagggcggacaaugacccggguuuuccaccgacuccagaugcgucccuccuccuacc

SEQ ID NO: 4196297 - RNA, 56 nt, Human
ggcaggaggugaguggcgggugagcgagcauugccaccugagcuccaccuccugcc

SEQ ID NO: 4196298 - RNA, 56 nt, Human
ggcaggcaagucugcucugugauuuucucuaccucugugagcacaugggccucguu

SEQ ID NO: 4196299 - RNA, 56 nt, Human
ggcaggcacauuugggggccgugagcaccucagcacacccucuugcagugucugcu

SEQ ID NO: 4196300 - RNA, 61 nt, Human
ggcaggcacugugauagauucugagaauacaaaacucaaugaauaagacacauugcuugcc

SEQ ID NO: 4196301 - RNA, 57 nt, Human
ggcaggcaggagcgugcuugggaccacugcuggcuccagacacugccuugcugugcu

SEQ ID NO: 4196302 - RNA, 62 nt, Human
ggcaggcccugcacagugguccuguguuuagucagcucaggcccagucugacaggggcuguc

SEQ ID NO: 4196303 - RNA, 78 nt, Human
ggcaggcgggcgagcugcaggcggggucgcagcggcuguuguugaagaggcgccagcacugcagcgccucgcauugcc

SEQ ID NO: 4196304 - RNA, 81 nt, Human
ggcaggcguugggacagcugugguagugagggccacuuuauucugugcuacaugaagagaggcugucugacaaagcuugcc

SEQ ID NO: 4196305 - RNA, 79 nt, Human
ggcaggcuccccaccgugaggccaagccuccucugccacugccagcauggcccaagggaggcuuggccuugggcuugcc

SEQ ID NO: 4196306 - RNA, 66 nt, Human
ggcaggcugucuaaaguuagagucaucugaacaaccacaggcauucuaauggcagagacuccuguc

SEQ ID NO: 4196307 - RNA, 55 nt, Human
ggcaggcuguucaccugcuuuugcaaauaaaguuuuauuggaacauagccaugcc

SEQ ID NO: 4196308 - RNA, 56 nt, Human
ggcagggaaacagcugaucccagacuagcuggugucagccuggugauuccucuguc

SEQ ID NO: 4196309 - RNA, 59 nt, Human
ggcagggacagaaaugguggcuaccauuccccacaggcagcucacaguucuguccuguc

SEQ ID NO: 4196310 - RNA, 69 nt, Human
ggagugagaauggcacaagaggucuggcuuucugacgauguaacugucucucuguguacagucucaccc

SEQ ID NO: 4196311 - RNA, 62 nt, Human
ggagugagcaaauagagauuugguccaaaaguucaagccaggaucucugucuugugugcuuu

SEQ ID NO: 4196312 - RNA, 58 nt, Human
ggagugaggaugucauggaccucacagaaggugacagugaggccucagccucagcucc

SEQ ID NO: 4196313 - RNA, 82 nt, Human
ggagugaggggcagcagggggucauucacgcuggcucugcucuguuagcugaaugacagccucucucucugagucucacucu

SEQ ID NO: 4196314 - RNA, 76 nt, Human
ggagugcaauggggcaauaucagcucaccgcaaccucugcuucccagguucgagcgauucuccugccucagccucc

SEQ ID NO: 4196315 - RNA, 89 nt, Human
ggagugccugugaggggccagcugccuguucugccaguuugccuagagggcugggacaggcuuggcccuguggauaagguucaaacucc

SEQ ID NO: 4196316 - RNA, 65 nt, Human
ggaguggcagagcugggauuuggggcaguuugcuuggccccaaagcccugcucuccuuccacucu

SEQ ID NO: 4196317 - RNA, 67 nt, Human
ggaguggcagcgaggaucagauuucuccagaaucacucggaguaauaucuauccucagcagccgccc

SEQ ID NO: 4196318 - RNA, 71 nt, Human
ggaguggcagggucuugcuguguugcccagggugggcuugaauuccugggcucaagugauccucccacuuu

SEQ ID NO: 4196319 - RNA, 57 nt, Human
ggaguggccucuccugugcaggguaagaaaggcauucauggaagggagugguccucc

SEQ ID NO: 4196320 - RNA, 66 nt, Human
ggauugccaucugguugauuucauuccgguuaguuuggccaaauaccauuaaccagaaaacaaucc

SEQ ID NO: 4196321 - RNA, 77 nt, Human
ggauugccgaugccugggcaccacucaaaccaauuaaaucauucuuacuggagguggggcccuggcacugguauuuu

SEQ ID NO: 4196322 - RNA, 57 nt, Human
ggauugcugguagucagugucccugggcugccaggcacacaggcauccaguauagcc

SEQ ID NO: 4196323 - RNA, 90 nt, Human
ggcccuuccagacuuugccacugaccuccaacccucgguuuauaggugccagggcuguagguaaggauggcaaaggaauaugaaggaguc

SEQ ID NO: 4196324 - RNA, 129 nt, Human
ggccgagcccguggccuggccgaggaggccgccgcucugcgaggggagcgcuguuuuccaggccggcgucuggaauguugcucugccuugcggugugagccgacuccugcccccauuucagcugcggcc

SEQ ID NO: 4196325 - RNA, 58 nt, Human
ggccgcaccugcauuccccucaaugggagcccgagagaaaggcuugcaggcuguggcu

SEQ ID NO: 4196326 - RNA, 55 nt, Human
ggccgcccccugugagcccgaucaugugcuuuuugggcuuaggucggaggcggcc

SEQ ID NO: 4196327 - RNA, 88 nt, Human
ggccgcgagcggcgugacagcugccagcucaccggcucagacggucgccgccgcguuugcgcagggggagcuggucgccgccgcggcc

SEQ ID NO: 4196328 - RNA, 65 nt, Human
ggccgcgguugaggaugccugggucggggaaggucgacgccggcccgcccggucgccuggcggcc

SEQ ID NO: 4196329 - RNA, 68 nt, Human
ggccgcuguggauggcaggacagacagaaggaacugcucgacuguccuccggccaccuacaguuggcc

SEQ ID NO: 4196330 - RNA, 94 nt, Human
ggccggaguaggcaaagcugccuucuaaauauuugucuggagauuagccuacuccugcagcucugagaagcaucuuugauuuacuuauacugcu

SEQ ID NO: 4196331 - RNA, 87 nt, Human
ggccggcaugaagacuacaggaggaugugcagccagggagaacgaagacaucuuggcauguucaucugcuugguacagauccugguc

SEQ ID NO: 4196332 - RNA, 85 nt, Human
ggccggcgugcuugucacggacugguccuagagucucuacuugaaaggccuuggcgaaaccagcucuggacaggcauuucccgcc

SEQ ID NO: 4196333 - RNA, 63 nt, Human
ggccgggggcggcggggugagggggggcagcagcucgccacucugauuggucaccucugcucc

SEQ ID NO: 4196334 - RNA, 80 nt, Human
ggccguccugggcccaggggcugccugguggcuucaaaaugcagccaguguggguugggccggguuggguccaggauguc

SEQ ID NO: 4196335 - RNA, 68 nt, Human
ggccgugcccugggggaguucagccgcacucaugagcaccuccccccgagcugccccugggcacugcc

SEQ ID NO: 4196336 - RNA, 104 nt, Human
ggccgugggcagcccggugcccgagauccaguggugguuugaagggcagggucccaacgacaccugcucccagcucugggacggcgcccggcuggaccgcgucc

SEQ ID NO: 4196337 - RNA, 97 nt, Human
ggccgugucccuagugacgcggugcggcaaguucauggggaugaugucugcaaagcgcugcaccucguggaucaccgcgucuguguaaggcauggcc

SEQ ID NO: 4196338 - RNA, 65 nt, Human
ggccguucaucagaggaguacacaggccugaaaugacaccugccugcguccucugagggcaggcu

SEQ ID NO: 4196339 - RNA, 76 nt, Human
ggccuaaccaagcaaacuuucauuguuaugugguuucuaggucuccuacagggcaaaaaguagugcugguuaggcc

SEQ ID NO: 4196340 - RNA, 78 nt, Human
ggccuaaccgcugguaucugugaaugugacauuaucugaagauaaggucuuugcaaaugcuagagauaaggugagguc

SEQ ID NO: 4196341 - RNA, 69 nt, Human
ggccuagacuaauauuuggaguuagugagauucucuauuucagaaggcucuggaauguguagucagguc

SEQ ID NO: 4196342 - RNA, 64 nt, Human
ggccuagcuguggaaaucaggcaaugagauggaagacucucagaggccuaugucuacaacugcc

SEQ ID NO: 4196343 - RNA, 61 nt, Human
ggccuaggaauccuuuuagaguugguaaaagacauggaccugacacaaaaggauucuugcu

SEQ ID NO: 4196344 - RNA, 57 nt, Human
ggccuaggaucuugaucuacuuaggaaaucugaguggcuccaauuugguccuauguc

SEQ ID NO: 4196345 - RNA, 107 nt, Human
ggccuaggcagcugugugugugcacgugugucguggaggccuacgcagcuguguguguguguuguggaggccuagguugaugugugugcacguguguuguagaggcc

SEQ ID NO: 4196346 - RNA, 59 nt, Human
ggccuagggaugaugucuaaaaucaugccacaagaugugguaacaucagaacccuggcu

SEQ ID NO: 4196347 - RNA, 121 nt, Human
ggccuagggcagcguggcuggcucccucacagguacugcuucuguucuuucaccuacgggccucuugguugccacagggaguuacagaagcacuucucagggacucuuugcuugccaggcc

SEQ ID NO: 4196348 - RNA, 99 nt, Human
ggccuaugaauaagcaaaagaccaaaaagccucuguuuuuccuuuuaaaauguggagauaauuaagacugcccauguuuuuauuuguuugacuagagcc

SEQ ID NO: 4196349 - RNA, 83 nt, Human
ggccuauggcuuuaacauccucuuuauggcuuccugugugucuagcacaguccuggccccaaggaaggauggcauucuagguc

SEQ ID NO: 4196350 - RNA, 67 nt, Human
ggccucaccacccucggugcgggguccugaugcccgcugggcccuccccucuggguggugagcagcc

SEQ ID NO: 4196351 - RNA, 67 nt, Human
ggccucagaccggagcuggccaguguccuucucaccacauuccacuggucagugcagucauggggcc

SEQ ID NO: 4196352 - RNA, 73 nt, Human
ggccucagcauucuguggucuucuauggagaaaggcuaauuuucugaaggcuuugaauggaaugaaaacugcc

SEQ ID NO: 4196353 - RNA, 71 nt, Human
ggccucagugggccgcugcaggggccccaugacugggcucuccaugccaaccuggguucucaucugaggcc

SEQ ID NO: 4196354 - RNA, 77 nt, Human
ggccucauuuaaaguguuggguguccaggacucagcagcauggcuuguguucaaucauuccaacacuuuaaaaugcc

SEQ ID NO: 4196355 - RNA, 55 nt, Human
ggccucauuuuuuguaaaugaccucugaguugaaagaaaguuucaaaaugaggcc

SEQ ID NO: 4196356 - RNA, 62 nt, Human
ggccuccaaccauagguccaggggcugagacaagguccuuuugagcuccuaugugggaggcu

SEQ ID NO: 4196357 - RNA, 71 nt, Human
ggccucccaaagugcugggauuacaggcgugcgccaccgcgccaggccgauccuugcacuuuucagagccc

SEQ ID NO: 4196358 - RNA, 67 nt, Human
ggccucccagcacuuggugguuuagccugaguuucuuacauggcagcuggaucccaaggcagagguu

SEQ ID NO: 4196359 - RNA, 77 nt, Human
ggccuccccugcaggcaugugauguuuggcuccagaggccuucuccucugggcuuuuccaugccugugaacugggcc

SEQ ID NO: 4196360 - RNA, 66 nt, Human
ggccucccgggaugcagaaggagccaugcuugcguggacagccugcgagaugucuucugcgaggcc

SEQ ID NO: 4196361 - RNA, 58 nt, Human
ggccucccugcucacacacccaggucacucucugggaaccagugcggcugggguggcc

SEQ ID NO: 4196362 - RNA, 65 nt, Human
ggccuccuagggcaucaggggcagccgaugugagcagcacugucugcccugagaugccagaggcc

SEQ ID NO: 4196363 - RNA, 55 nt, Human
ggccuccucucucuguccccccagugauggcacuggaagggcucugaggacggcu

SEQ ID NO: 4196364 - RNA, 56 nt, Human
ggccucucuccagucagugcagcccaguuguugugcggaugaggccuggaggggcu

SEQ ID NO: 4196365 - RNA, 56 nt, Human
ggccucucugagagcagacguuggccucugugccucucugcuucuccuagaaggcc

SEQ ID NO: 4196366 - RNA, 121 nt, Human
ggccucugacccauuuuucuagcggacucauuaccucuuauuuagccuugaagacucugguggcugauuggcagagaagcuuucacagcugggaagagauaugggaucugggucagcugcc

SEQ ID NO: 4196367 - RNA, 129 nt, Human
ggccucugccagcccuugcagcugcagcccaucccugggccauguccccuccaucgagugcccggugcuugggggaggagggcagggacagggagggagccacagucagugcccgggaaccuggaagcu

SEQ ID NO: 4196368 - RNA, 79 nt, Human
ggccucugcuaucacccuacauaagaaauaauuccaaaaggauuauagaucuaaaugugaaggguugaaccagagagcu

SEQ ID NO: 4196369 - RNA, 90 nt, Human
ggccucuguaggggccugugucugugccuguccugcucggcacauagaggaaagccagggccggggcaggcaggggucucuggcugggcc

SEQ ID NO: 4196370 - RNA, 60 nt, Human
ggccugaaggugcaguggcuggaggcuguugccaguucucagaauugcaccucaacugcc

SEQ ID NO: 4196371 - RNA, 57 nt, Human
ggccugaaugccugagugugggcuuuccaaauugaguucucacuggcacaucaggcu

SEQ ID NO: 4196372 - RNA, 71 nt, Human
ggccugaauggguuugugcaggagggggcugccuugaagugguccccucccuuccaacagagcuugaggcc

SEQ ID NO: 4196373 - RNA, 62 nt, Human
ggccugacccugccgagcugcuccgggaaguguuugcuggaagcucaaggcagggugagccc

SEQ ID NO: 4196374 - RNA, 68 nt, Human
ggccugagaauaauucuccauagcccucagcuucaccaucugggcucuggguuuguuguucuuuuucc

SEQ ID NO: 4196375 - RNA, 59 nt, Human
ggccugagggugggcucucaguggcccuguugcuauccuguggccccacccucuuggcc

SEQ ID NO: 4196376 - RNA, 57 nt, Human
ggccugauucugcagccuggugggcagaggagacuggcaggaggcaaggucaagguc

SEQ ID NO: 4196377 - RNA, 70 nt, Human
ggccugcagcccuugguauuuuccgaucccagcugcucugugaggguggaaaguauuuggggaccaggcu

SEQ ID NO: 4196378 - RNA, 76 nt, Human
ggccugccagaggaggccggccuugaagcuucuuuuaggaaaaaggcccugaagucggccccucaccccggaagcc

SEQ ID NO: 4196379 - RNA, 81 nt, Human
ggccugccccugcccuacucugucccccccaugcccacggcagacaggcagugggcaagcaggagggccucagggcagguc

SEQ ID NO: 4196380 - RNA, 113 nt, Human
ggccugccccuugggaggaugcagaguggaugaaauugggggcugaugaguuccccucauagacaaucccccauccuaccucaucccuaguccuggauaucuggggccaggcc

SEQ ID NO: 4196381 - RNA, 72 nt, Human
ggccugccuaccugggcccaccagugccuggcccagaggagaggaacagagcugggcuucaggccugcagcc

SEQ ID NO: 4196382 - RNA, 121 nt, Human
ggccugccugccccuguggggugcuguggggugcuagccugggacccagaggccccuuggcauuugcuggcagccucccagcugcauuccucagcauggagcccgagggagagaggaggcc

SEQ ID NO: 4196383 - RNA, 91 nt, Human
ggccugcgcaccuguuccccagggcccaagccgccuuccagagacccauagguuugggaagcaggggcuuggucaccggggugcgcagguc

SEQ ID NO: 4196384 - RNA, 58 nt, Human
ggccugcuuugagaugggcagcagcuacuccagggugcguugaccugcagagcaggcc

SEQ ID NO: 4196385 - RNA, 68 nt, Human
ggccuggagcugggcuaggguaggaguccccugugaggcuccaccucugccucuccagcuccuuggcc

SEQ ID NO: 4196386 - RNA, 65 nt, Human
ggccuggccauagggcccaggaaaaugcagguaucauuaacagccuggagcacuguggccugucc

SEQ ID NO: 4196387 - RNA, 68 nt, Human
ggccuggcccagugcuguucacccagugcuguaauugcacugugauuaccugcacuggcccuccugcc

SEQ ID NO: 4196388 - RNA, 62 nt, Human
ggccuggcugcuuagccuacuucccuugggccucugugggccugggcggccauguguaggcc

SEQ ID NO: 4196389 - RNA, 63 nt, Human
ggccuggcuguuucaggcagugucccucucuccaggcuuggugggcaggcugagaugccagcc

SEQ ID NO: 4196390 - RNA, 73 nt, Human
ggccuggcuuugaaaugcauuucagucucucaacacagacugcuuucauugcauuuagagucccacuaaggcc

SEQ ID NO: 4196391 - RNA, 124 nt, Human
ggccugggaccuagguucaaauccuggcaucaccaccuacaucuguguggccuccauaggguacuuugguaauaauaaauauucaaugaggucauauaagcuaguguuggcagaggcccagccc

SEQ ID NO: 4196392 - RNA, 94 nt, Human
ggauugcuugagguuaggaguuugaggcuuugguucacuauaaucaugccuguauauggccacuguccucuagcccagacaacauagcaagacc

SEQ ID NO: 4196393 - RNA, 79 nt, Human
ggauuggggccugguuguugcuuucgagggugugggaagaggacacaucacagugauaacuaaguccugcaugcagucc

SEQ ID NO: 4196394 - RNA, 57 nt, Human
ggccugugggaggacagcuggggccggcuccaggcccccugguccccacacagagcc

SEQ ID NO: 4196395 - RNA, 70 nt, Human
ggccugugucucccccagcuacucugagugucugaacacucaucuucccuccuggagggaggcuuaggcc

SEQ ID NO: 4196396 - RNA, 67 nt, Human
ggccuguguuuuuaacucuaggagucaugaucugaaugugaaauuccaagggcuacaaacacagacc

SEQ ID NO: 4196397 - RNA, 65 nt, Human
ggccuuauugacugucauucuccaugcuugaguaagcauuagcucaugccuuugauagucaggcu

SEQ ID NO: 4196398 - RNA, 61 nt, Human
ggccuucagcgccuucaccaccagcgccuuggccagaugcuggccggccaggugcugagcc

SEQ ID NO: 4196399 - RNA, 81 nt, Human
ggccuuccaggcgcaugcucccaucugcguuaucugccucagaucaaaagagaaaaugcaugagaaugugcucggaaggcc

SEQ ID NO: 4196400 - RNA, 60 nt, Human
ggccuucugaagcaucuaggagaaaauccaucuccuugauuuuuccagcuucuagaggcc

SEQ ID NO: 4196401 - RNA, 61 nt, Human
ggccuucuggaguggagcugaucauuuuaauaugcuaauauaucaucaccauuuugaggcc

SEQ ID NO: 4196402 - RNA, 61 nt, Human
ggccuugagagccagugcaggcccaggagagcugagagucaccugugcugcccucggggcc

SEQ ID NO: 4196403 - RNA, 130 nt, Human
ggccuugaggucacaaaaugaauaaugauccuuacauuccugcaucugcuuuuggggcucgcccuguuaaaaccacaggugaggacaacaugggaagauuuauaguucucagccuguguaccuaccugcc

SEQ ID NO: 4196404 - RNA, 100 nt, Human
ggccuugaugccuccuugccugacuggugggaagauggaaaacauuuuugcagcucaagagguugguucuggcccccacauucaauggggcucuagggcc

SEQ ID NO: 4196405 - RNA, 55 nt, Human
ggccuugcagccacagaacacagcaagugcuaaggcccugaggcuggcaggagcc

SEQ ID NO: 4196406 - RNA, 85 nt, Human
ggccuuggaagcagguacauucguagacccauuuugcagacaaggaaaguacagugcaacuagaugauguagcuuguccaagguc

SEQ ID NO: 4196407 - RNA, 56 nt, Human
ggccuugggcagacacgucacacacuuuacuggaucaaacggugucagccuuggcc

SEQ ID NO: 4196408 - RNA, 64 nt, Human
ggccuugggcuggcugcaguaucaggcccugcuggcacacagcugcaacuggccaggccaggcc

SEQ ID NO: 4196409 - RNA, 67 nt, Human
ggccuugguuccaaagcaggcaucuaaaggguucccugggcuggcuaaaggcuuuggagcugaggcu

SEQ ID NO: 4196410 - RNA, 55 nt, Human
ggccuuguguggcucucagcugccccuccucugagcagcuggagccaagagggcc

SEQ ID NO: 4196411 - RNA, 61 nt, Human
ggccuuguguucccuucuccucugcuuauuuucaugagccagcaggugggaaacuggagcc

SEQ ID NO: 4196412 - RNA, 65 nt, Human
ggccuuuaagcaauugaaaagaaauaucuggcacaagcucugagaaacuuauuguuuaaauggcc

SEQ ID NO: 4196413 - RNA, 66 nt, Human
ggccuuucaguuccaucaaaggaagauaaguccccacucauugucccuggaggaaacugugagguc

SEQ ID NO: 4196414 - RNA, 56 nt, Human
ggccuuugcccgugggccuugcacucuccgugacaaggcgacacaggcagcaggcc

SEQ ID NO: 4196415 - RNA, 60 nt, Human
ggcgaaggagcuggcagggcuuccagguucacuguggagcagcuggggugcucuuuuguc

SEQ ID NO: 4196416 - RNA, 58 nt, Human
ggcgacgcauguauugggauuaacauguaauaaacuuccuuaauccauaugcuuugcc

SEQ ID NO: 4196417 - RNA, 75 nt, Human
ggcgagaaaaggagggauaagaaccauccuaaagcuguaggacuggaagggauuuuagugacuccuuuaucugcc

SEQ ID NO: 4196418 - RNA, 73 nt, Human
ggcgaggccgaggcggcugaggcugcuuuagcuccugcuccgggcuggagcugccagggcugccgccgccgcc

SEQ ID NO: 4196419 - RNA, 59 nt, Human
ggcgaugcucagauuuuugaccuguuuuccaacucugaggucaaacuacuggcagugcc

SEQ ID NO: 4196420 - RNA, 58 nt, Human
ggcgauuuugacauugcggcauugcucagcauggcgggcugugcuuuguuagguuguc

SEQ ID NO: 4196421 - RNA, 112 nt, Human
ggcgcacgcugugcuaggccccggcagcccuggcgcccccagaucucccagaggagagggagcugccaggcgccacggcuucccuggggcucugagcgcuuuggcgagcguc

SEQ ID NO: 4196422 - RNA, 71 nt, Human
ggcgcaggcagcucuaauggaaagugccgucaccaaagagcaaagcauuauuuaugacugucuguaaugcc

SEQ ID NO: 4196423 - RNA, 86 nt, Human
ggcgcaggcuucagaauuaaugucacaucugggauggcccugauguggucagaggcacaacagucccauuguguuugacuuguguu

SEQ ID NO: 4196424 - RNA, 58 nt, Human
ggcgcagguguucucagaggaggcuuggaagagcugacuuuaaagggacaccuaugcc

SEQ ID NO: 4196425 - RNA, 60 nt, Human
ggcgcaguguucgcccucucgccacgaaguaaacaagugggagggucugagagcugcacc

SEQ ID NO: 4196426 - RNA, 59 nt, Human
ggcgcccagggcaggaggccgcucagagcgcagcagcaggaguggaagcucggggcgcu

SEQ ID NO: 4196427 - RNA, 62 nt, Human
ggcgccuggcugcuagccagaggcagcguucgaaauacaacugccucggcggcggcggcgcc

SEQ ID NO: 4196428 - RNA, 86 nt, Human
ggcgcgccagcagcgcgggccaggcgcagaagcgcagcaccagcaggcugcgcgccagcucccagguucgccagcugcaguacgcc

SEQ ID NO: 4196429 - RNA, 57 nt, Human
ggcgcgccguggacagcccuggcgccgcaggggccuggggcucaagauggcgccgcu

SEQ ID NO: 4196430 - RNA, 59 nt, Human
ggcgcgcggagcgggcgcgccgccaacgcggucacgugcgcggccccuccucucgcgcc

SEQ ID NO: 4196431 - RNA, 60 nt, Human
ggcgcgggagcagcucgcuaggcacugccacaugcagcugacuguccgcugcucccggcu

SEQ ID NO: 4196432 - RNA, 94 nt, Human
ggcgcgggccuacagcucacucacagggcuaguuagcaugcgcccaacgcagccuucuccguugcuggccuuugaggaagcugcgggucuugcc

SEQ ID NO: 4196433 - RNA, 74 nt, Human
ggcgcucggaaccgaccugggagcuggcgggaccguccucccccgccacgcccucccaucgggcuuugggcgcc

SEQ ID NO: 4196434 - RNA, 62 nt, Human
ggcgcuguguuguugcccucugguccccaaagagauuaucgagggcugcugccagauaugcc

SEQ ID NO: 4196435 - RNA, 62 nt, Human
ggcgcuugaacaggguugggugagagaggaagucccuuacaguaugacacuguccagaagcu

SEQ ID NO: 4196436 - RNA, 130 nt, Human
ggcggaccugggagggcgguuugcuuuucuuuggagcgcgagacaggccucccauccggagccccagcucgcugggggcucacucggcugggauuggccugauuccccuccccugccugcccuccacccc

SEQ ID NO: 4196437 - RNA, 56 nt, Human
ggcggacgcgcacggccggcuuggcccgggccucgggcgcgccgucggguccagcc

SEQ ID NO: 4196438 - RNA, 70 nt, Human
ggcggagcucaguggggggacugugggaagaagaugcacccgcagacaccgcaccuccccugggccugcc

SEQ ID NO: 4196439 - RNA, 76 nt, Human
ggcggaggguugggggaguacugguggccucgguguccccuggaggccuggugugucucccgcuuccucucacgcc

SEQ ID NO: 4196440 - RNA, 72 nt, Human
ggcggagguccgcggccccccuucagccucgagguguccccagggggcugggaggccgugcugaccuuugcc

SEQ ID NO: 4196441 - RNA, 63 nt, Human
ggcggccccuaauugguugguuagcugaaagucaagggauggcaguugcccagccaauccgcc

SEQ ID NO: 4196442 - RNA, 70 nt, Human
ggcggcgguucugggaagagcaccaggcugcuccaggcaggaaagggcucugaaucccaggucugccucc

SEQ ID NO: 4196443 - RNA, 129 nt, Human
ggcggcugggggccgccaggaccuggggucuguccguaguaagcggccugcugucuguaauauuccgcccaggcggcacuguagucuggcugggagccugggggagcuccuggacccccuccgguggcc

SEQ ID NO: 4196444 - RNA, 80 nt, Human
ggcggggaggcgggagcaggagcccgcggccggccagccgaagaugguggcggcuacuccuccuggugagucugcccgcc

SEQ ID NO: 4196445 - RNA, 79 nt, Human
ggcgggggccacguggcccugccccgccccugcuggcuucgguuccugagcagagcugcaguggccugcuuuccccgcc

SEQ ID NO: 4196446 - RNA, 83 nt, Human
ggcgggggccgggcuggggcgcgggcagggggcgucgggcgaccgugcaccccggggcccugcuccucgccccuucccccacc

SEQ ID NO: 4196447 - RNA, 86 nt, Human
ggcgggggcuggccgcgcgucgggcgccaggcccggggcugugggcaccgugcccagccccuggcgcacgccgagccgccgccgcc

SEQ ID NO: 4196448 - RNA, 95 nt, Human
ggcgggggguuccuugagcccaggaaguggaggcugacuugagccgugaucacaucacugcacuccagccugggugacagagcgagauccccucc

SEQ ID NO: 4196449 - RNA, 70 nt, Human
ggcggguggcuaggcccaacggcaggaagccgacgcuauccuccguuccgcggcgccggguccgccuucc

SEQ ID NO: 4196450 - RNA, 67 nt, Human
ggcgggugggugguccgcagacauauggcacgaauucagcacauguucugagguccaccgacuuucc

SEQ ID NO: 4196451 - RNA, 108 nt, Human
ggcgguacuugagggguuagccacgggugccagaaauucuccaggcuggcgggcagggggguccuugcuguugugggagacuggggccugugugcccccaggaccacc

SEQ ID NO: 4196452 - RNA, 122 nt, Human
ggacucaguucucauuuuccucccguuuucucuggauuguggcuauuguucucugguugcuagaucaagcuggagcacaguaaagcagugucacaaagcuggaaggggucugggaugagucc

SEQ ID NO: 4196453 - RNA, 55 nt, Human
ggacuccagccuuugaguccuugggaacccagaaggaccugagaguuggaaaucc

SEQ ID NO: 4196454 - RNA, 85 nt, Human
ggacucugacucagccaaggcccagccccucuuagcuuccucaucugcuaaaaggaagagcuggaccagaggacugguuuggucc

SEQ ID NO: 4196455 - RNA, 80 nt, Human
ggacucugagaauauaagacuauuucuguucauaaggaguuauuuuuuccccaagaaaagucuuuuccuaggguaacccc

SEQ ID NO: 4196456 - RNA, 59 nt, Human
ggacucugccagguggcuucugcucagggucuccuguugagugcagcaagguagagucu

SEQ ID NO: 4196457 - RNA, 88 nt, Human
ggacucugguacuguggcuguagaagaaaaaucuccuuuacuuauuuuaguauccagguuccucuucauguucaacaguaaggacucc

SEQ ID NO: 4196458 - RNA, 71 nt, Human
ggacucugucgggauucaguccaagcgggggcgaccuuggccucugccuccugcuugucccgacgcauucc

SEQ ID NO: 4196459 - RNA, 69 nt, Human
ggacucuuauaaagaugucucuguugcggggggucucuuaccuggaaugggauaggucuucaggaauuc

SEQ ID NO: 4196460 - RNA, 102 nt, Human
ggacugaaaacacaccuucaaugaaaauaauagucaauggaauaggguaaauauuaauaucuacaggauuauuaugaguuauuaaggugaguauggcagucu

SEQ ID NO: 4196461 - RNA, 79 nt, Human
ggacugaaugacuucuucagauacuuugcaaggcaugacuguauauaaggcaaguauucuguaaaaagucaacuagucu

SEQ ID NO: 4196462 - RNA, 68 nt, Human
ggacugacucuucuguaaauucagaaaugucuccaugcucugauguuucucauccagagagucagucc

SEQ ID NO: 4196463 - RNA, 75 nt, Human
ggacugaugucagccuuugguuaucuuggacaugaaggauuacaauagcugagucaucaaaggcugauucagucc

SEQ ID NO: 4196464 - RNA, 57 nt, Human
ggacugcagaauaauuuaagcuuuucaucugaguuagaaucuguauuucugcaguuc

SEQ ID NO: 4196465 - RNA, 74 nt, Human
ggacugcugugucucccaaggagggucacugggucaaagaggcccccuggagccuugugagaccacaauagucu

SEQ ID NO: 4196466 - RNA, 119 nt, Human
ggacugucuuacaggcuuuuggaguuggccugggaagagggcauggugggccuugguuagacugccauuuccacacuugcugucugcugaggauggcuccucucuaugcuggauggacc

SEQ ID NO: 4196467 - RNA, 58 nt, Human
ggacuguggugcuaaaaggagacugacacagacuagucuuggaaguagaacacagucu

SEQ ID NO: 4196468 - RNA, 66 nt, Human
ggacugugugggugucuuucaguauucucuuucuacuucugcugcagcugcaaaaacauacaguuc

SEQ ID NO: 4196469 - RNA, 61 nt, Human
ggcugcaguaauagcagagucuuccaugcaaccaugcagauaauuuagcuguucuguggcc

SEQ ID NO: 4196470 - RNA, 61 nt, Human
ggcugcaguagagcccucacugggaguuucuuccagugcaccaagaggccuagacucagcc

SEQ ID NO: 4196471 - RNA, 64 nt, Human
ggcugcauaguguaagaauguaucaugccuacaauggucuucaucuucaguacacuugcacgcc

SEQ ID NO: 4196472 - RNA, 70 nt, Human
ggcugccacccaggacacggcagagauaagcgcaggugaguguggccaugccugucuuggaguccuggcc

SEQ ID NO: 4196473 - RNA, 127 nt, Human
ggcugccagaguggggaauagguaaugacuguuuuauggguauaggguuuuauuuuggagugacuaaaauuuuuuuggaaagacauagaauuuguacuuguagaacauugcaaauauacuaaaugcc

SEQ ID NO: 4196474 - RNA, 60 nt, Human
ggcugccaguuccuucuuacuccagcccaagucaggaaaaucaagcaaggaacugcuacc

SEQ ID NO: 4196475 - RNA, 86 nt, Human
ggcugcccagucuggucaugucagcuguugaugugcagggagccccugcugcacagcccgcuggcccagagaucaugcagguaguc

SEQ ID NO: 4196476 - RNA, 69 nt, Human
ggcugcccugacugaccuuuugaauaugagucucagagauaaguuuucaagcagcucagggacacaguu

SEQ ID NO: 4196477 - RNA, 64 nt, Human
ggcugcccugauaugauuuagaacaugaacaccaugaccuaaauguucucagaggguaauaguc

SEQ ID NO: 4196478 - RNA, 77 nt, Human
ggcugccgaggaugggaaaucagggugaaaguugaggcugagcugcaagauuugguuuucuauccucugcaauggcc

SEQ ID NO: 4196479 - RNA, 73 nt, Human
ggcugccugaguggaggucgagggaaagucacugccugcaucggcuguccccuccuuccccuucaaggcugcc

SEQ ID NO: 4196480 - RNA, 58 nt, Human
ggcugccugcuccuccugcacggggcgaaaagcccaccugggauccgagcgggcggcc

SEQ ID NO: 4196481 - RNA, 59 nt, Human
ggcugcgaccgcccccgaaccgcgucuacgagccuugcgggcuccgggucuuugcaguc

SEQ ID NO: 4196482 - RNA, 129 nt, Human
ggcugcguuccccgcaccucaagaggucugagcucgccccacugucugcucgggguucccaccuggcccgggccaggaggagcaucgggcaggaggcgggucucagggccgggcagucugggugugccc

SEQ ID NO: 4196483 - RNA, 78 nt, Human
ggcugcuacuaguccuguguguggccuuucccagcguguucuuaccugugggccaugaucauagugcugggccgagcc

SEQ ID NO: 4196484 - RNA, 60 nt, Human
ggcugcucacgcagcccucccuguggccuguucuccaggagauggggcugagugacagcc

SEQ ID NO: 4196485 - RNA, 59 nt, Human
ggcugcugcuguguaggccuguuuccugucaccaggguucagagccaagagcagcaucu

SEQ ID NO: 4196486 - RNA, 86 nt, Human
ggcugcugcuugcuggacacacuggagucuggcagggucagcugagcagcucuugucuccucggcuguccagccagccuggcagcc

SEQ ID NO: 4196487 - RNA, 56 nt, Human
ggcugcuguacugaugucaguuuuuauuuauugagugcuuagcaggcauaguagcu

SEQ ID NO: 4196488 - RNA, 120 nt, Human
ggcugcuguggaaaccuuaagagacugcgcccccuggugucagaacgcugucauugcagcaugggacuuccagccuggggaggcagcuucucaccugcagacgagggcuccacccuagcc

SEQ ID NO: 4196489 - RNA, 77 nt, Human
ggcuggaauacaagacucagcacagacggccugaaacccagccugaggugguagcugggguuuguggcgucacagcc

SEQ ID NO: 4196490 - RNA, 130 nt, Human
ggcuggaaucucaugccucuggcuuuauuggucugggaucucuggggcauccccaucccuaaaccuccaauggacuuugcccuaaugaggucucuuugcaguggcccugacccugugauuguucucugcc

SEQ ID NO: 4196491 - RNA, 80 nt, Human
ggcuggacaguggugggugggggucaagcuggaagguuccauggggcuuucaaacuccagcucaccaaucaaguggggcu

SEQ ID NO: 4196492 - RNA, 91 nt, Human
ggcuggaccugaccgaugcccuuucaucauugcacugcuucccagcggccuauaguagugcaacagggaaagagugucgggcaggccugcc

SEQ ID NO: 4196493 - RNA, 56 nt, Human
ggcuggagggagagugaagagggaagagaauacaguccuugcuauuuuccucagcu

SEQ ID NO: 4196494 - RNA, 56 nt, Human
ggcuggagugcaauggcacgagccucugccucccggguucaagccauucuccugcc

SEQ ID NO: 4196495 - RNA, 77 nt, Human
ggcuggagugcaauggcaugaucugggcucacugcaaccugugccuuccagguucaagcgauuguccugccucagcc

SEQ ID NO: 4196496 - RNA, 77 nt, Human
ggcuggagugcaguggcaugaugugggcucauggcaaccucugccuccugggcucaagugauccucucaccucagcc

SEQ ID NO: 4196497 - RNA, 126 nt, Human
ggcuggagugcagugguggaucacaacucacuguaaccucaaacucuugggcuuaaggaauccucccuccucagccuccgaaagugcugggauuacaugugccacccugccuggucacucuuagcu

SEQ ID NO: 4196498 - RNA, 62 nt, Human
ggcuggcaccugcccuccgcuggucauucaggaacugcgggggcuccuggugcucaagcgcc

SEQ ID NO: 4196499 - RNA, 61 nt, Human
ggcuggcagcaugucccggccucagugccucugcugugaacuggcacaggcugccccugcc

SEQ ID NO: 4196500 - RNA, 69 nt, Human
ggcuggcagcucacugauuagcaauuauuuucccagaaaguugguagaagcgguggugucugcugagcc

SEQ ID NO: 4196501 - RNA, 62 nt, Human
ggcuggcaucacuggcuucgguguauuauuaucuuggugccugguucuaaugaaugccauuc

SEQ ID NO: 4196502 - RNA, 82 nt, Human
ggcuggcaugagcacgaagugguacccauaggccacucacaucuggaaggcugcaaugguaccaccaauucagcugccagcu

SEQ ID NO: 4196503 - RNA, 92 nt, Human
ggcuggcgcggccugugcuggcgggaaucguagcuaccaucugcuucuuggcagcugccauccuguucagcacccuggcugccugcuuuguc

SEQ ID NO: 4196504 - RNA, 73 nt, Human
ggcuggcucagggggauuagcaauuaucugaacucacacuuagaaauccuugaccuguuccccuugguccauc

SEQ ID NO: 4196505 - RNA, 124 nt, Human
ggcuggcugucacauccccacuggacaaaugaauuacauguaagaucaaagccagugaggagugagguuauuggccugcauuggcuuuggugugugugugugucugugugugugucuguguguc

SEQ ID NO: 4196506 - RNA, 62 nt, Human
ggcuggcugugcccuguacucugggggugcccgggugggucugguggaggguggagugggcc

SEQ ID NO: 4196507 - RNA, 56 nt, Human
ggcuggcuuggugagcugucacuucucuccugaagccuucccacucccaguuagcc

SEQ ID NO: 4196508 - RNA, 56 nt, Human
ggcugggacggcucaguaagaagggucugggcucucucccugcccugucccaugcc

SEQ ID NO: 4196509 - RNA, 88 nt, Human
ggcugggacugaggucauguucugucagguuccaaagagcgccaggaagacucugagaccacagagcacggccugcuuucucccagcc

SEQ ID NO: 4196510 - RNA, 57 nt, Human
ggcugggaggggagcggggcugugagcaggagcuaauggccgccuguccuucccgcc

SEQ ID NO: 4196511 - RNA, 56 nt, Human
ggcugggaguguuugcaccaagaaaaauccaucucuuagcaaacauucuuccaguc

SEQ ID NO: 4196512 - RNA, 93 nt, Human
ggcugggcagaaggcgggugugggacgggugaguggccagcuaaaagugauuggcagcugccauguccacgugcuccgagcuuggaaccagcu

SEQ ID NO: 4196513 - RNA, 90 nt, Human
ggcugggcuccuaucugugccuccguaacacaccaggcccacuuucucucccugguuccuggggaggcacagagaagagugugaccaguu

SEQ ID NO: 4196514 - RNA, 66 nt, Human
ggcugggcucuuggaccccaacgcuggcccccaguuccugccagccaccuucuccaaggccuagcu

SEQ ID NO: 4196515 - RNA, 72 nt, Human
ggcuggggacacagagccaaaccauaucacccugcaaauccaagggggcacuccucugguccagccccagcu

SEQ ID NO: 4196516 - RNA, 83 nt, Human
ggcuggggcugcgggguugggacugucaucuggaggcucagaaacgcugcccuccauugucugggaccccagcagccccagcc

SEQ ID NO: 4196517 - RNA, 84 nt, Human
ggcugggguuugaguuuuggcuuuguugcuuguguacuucaguuaggauuucuuaguugcaagcagcccagaacagcucuggcc

SEQ ID NO: 4196518 - RNA, 126 nt, Human
ggcuggguauugaggacacuggggacucuggacuggucuccuggguggcugccugccuuucugugcagaaggcuggcucagcuuuccagcccuggcuucuuagcuccccacuguuccuccucagcc

SEQ ID NO: 4196519 - RNA, 76 nt, Human
ggcuggguauuugaaggagaauuaauaggcauuggaauugaacauugccccuauauaauuuucuuuagaucuagcc

SEQ ID NO: 4196520 - RNA, 90 nt, Human
ggcugggugcaggaagaggggguggagcuaaaugucuacuggcuggguggguugcagaggguauggcuucaccuucauugguacccagcu

SEQ ID NO: 4196521 - RNA, 76 nt, Human
ggcuggguuccuccuggaggcucuagggaaaaaucgaauuucuuguauuuuccaccuucuggaggcuacccauguu

SEQ ID NO: 4196522 - RNA, 75 nt, Human
ggcugguagcaggacagggauucaaacucccaacugucugagugggccugggcuccuguccucuugcuaccuguc

SEQ ID NO: 4196523 - RNA, 79 nt, Human
ggcugguuaguugaggaggacuuagcugggaugguuugucucugcuccaugugaucucuccuccuccacuaggcuagcc

SEQ ID NO: 4196524 - RNA, 67 nt, Human
ggcugguuaucccacuucccugacauauguauuucuucaaagggagcucauaacaagguagccagcu

SEQ ID NO: 4196525 - RNA, 62 nt, Human
ggcugguucugcccuggacagccuuggccaaagcagagagagggucccugggcagaggcacc

SEQ ID NO: 4196526 - RNA, 86 nt, Human
ggcugguuuagacauuucugguuauugacaggccuuacugcggcuucccccaaaugaaugaggaauauauuuuucuaaauccagcc

SEQ ID NO: 4196527 - RNA, 61 nt, Human
ggcuguaccugccucuccucuacacuggaggaacccagcacagagaggccuggugacagcc

SEQ ID NO: 4196528 - RNA, 59 nt, Human
ggcuguaguugaugauuucugauauucuaaagaguguuaagaugcauuaccugcaagcc

SEQ ID NO: 4196529 - RNA, 57 nt, Human
ggcuguauugugucaccuauggaucugcccagagcccagugcauaaucaauacagcc

SEQ ID NO: 4196530 - RNA, 76 nt, Human
ggcugucagaaaguguggggguacaggugggcgugugcaguagucaugcccugugccagucacgcuguguugugcc

SEQ ID NO: 4196531 - RNA, 115 nt, Human
ggagcuuaagucauuauuucucacucuuuuuagaugccgcagaagaucuaacucuuaaccuggaccuauucaaagauagauguugagaaauacagaucaauggcucaaaagcuuc

SEQ ID NO: 4196532 - RNA, 60 nt, Human
ggagcuugccuaagguccuucaguaagucaguggcaaagcuggagccacagucagguucc

SEQ ID NO: 4196533 - RNA, 80 nt, Human
ggaggaaaggcagugguuggguggaggaggggaugacuguuuugcucagagccuccuucaguucaauuaguccgucuucc

SEQ ID NO: 4196534 - RNA, 103 nt, Human
ggaggaagaaaaaggaagugcucagggagcauagugaauuuaccugcucgugagcaauaaaucuuacuuaugauuuuucgguguuaucuguuuuucuucuuuu

SEQ ID NO: 4196535 - RNA, 57 nt, Human
ggaggaagcccucggugccccacaugugcuaagagggcagcagugagggcauccucc

SEQ ID NO: 4196536 - RNA, 114 nt, Human
ggaggaauaauaucuagccacuugguuaaaauuucaagugugcaaaauuucccacuguggaacugggaaauguuggacacuugaaauuuuaaccuauuggcuagacauucuucu

SEQ ID NO: 4196537 - RNA, 65 nt, Human
ggaggaccugccugcuggcuccacagaucagacucccagacuugaccagcugcuugcaggccuuc

SEQ ID NO: 4196538 - RNA, 69 nt, Human
ggaggacggugaguucugugaagguaaggcagaaacugcuuuaacacaucccugcucuacccguucgcc

SEQ ID NO: 4196539 - RNA, 107 nt, Human
ggaggacggugccaggugucugcaggcccugggcaggaucagccaguauccagcuggacuagaaccaagagcccuugggcgcuggagcugcuugggccugugccucc

SEQ ID NO: 4196540 - RNA, 63 nt, Human
ggaggacugaacagauguggagguaccuuguacacagcaggcacucagaguuaguucuccucc

SEQ ID NO: 4196541 - RNA, 66 nt, Human
ggaggagacuauccccuuuguucuaugaguugcuucuaaaguaggagccaaaggaaguuucccucc

SEQ ID NO: 4196542 - RNA, 77 nt, Human
ggccugaggccccccaggguuaacauguggucacggcauucuguggcagcacaagguggcccauggugggagaggcc

SEQ ID NO: 4196543 - RNA, 84 nt, Human
ggccugaggucugagaugcccuguggcaguacauauuuggguccuauccagguggcaguuacaggggcaaauuaugucauggcc

SEQ ID NO: 4196544 - RNA, 91 nt, Human
ggccugagucucucuagucuuuggggcauggccaguccuucauuuccugggcaggaacuguucccucacaggcuggagaccuuacagugcc

SEQ ID NO: 4196545 - RNA, 55 nt, Human
ggccugauucaugccaugcaguggguacacguccacagccugucaucucaugguc

SEQ ID NO: 4196546 - RNA, 56 nt, Human
ggccugcagcugcuuccacacaccuacugcaaaugccggugcugugggcaguggcc

SEQ ID NO: 4196547 - RNA, 59 nt, Human
ggccugcccagggucaccacagaggccucuugccuucuggucccuuccacugggcugcc

SEQ ID NO: 4196548 - RNA, 111 nt, Human
ggccuggacuccgagaugaacuggcuuggggcgcccucagguggccacauaaaaaaccacagucugaggccagccuggggcucccagaccugggcgggaucuuuccaggcc

SEQ ID NO: 4196549 - RNA, 66 nt, Human
ggccuggagaaaggaaggugggaaggccaggacucggacuuaccaccugacuccuacuccagugcu

SEQ ID NO: 4196550 - RNA, 67 nt, Human
ggccuggagcagagccuacacccucaucccagccucucccugagucuccaaggccucccuccaggcc

SEQ ID NO: 4196551 - RNA, 78 nt, Human
ggccuggagcugcuguccuugggugaaauugcucgugggcucaccuucuauucgggggacacagaauuccacucuguc

SEQ ID NO: 4196552 - RNA, 125 nt, Human
ggccuggaguggagcccucgcaggcucuugguacccuggcugucaagcuguguguuuggcugcccuguuuagccaggguuucaggagguuucugugccuguggggugcaggucagacuccagguc

SEQ ID NO: 4196553 - RNA, 113 nt, Human
ggccuggcccugggcggccgcgcaggaucuggggccguccgcgggcugcagcccgguucgggagccucguggcggccacugcgccugccugcagcggcucgcggggccgggcc

SEQ ID NO: 4196554 - RNA, 62 nt, Human
ggccuggcugacaccuugauagcagccucaugaaggacugaagcaaaggaucgagcuaagcc

SEQ ID NO: 4196555 - RNA, 55 nt, Human
ggccugggccuugccugagaccaugcagauggcauggcagaacaccucgcccgcc

SEQ ID NO: 4196556 - RNA, 74 nt, Human
ggccugggcuaucguggccuccuaggcucacuccuggaagacagagacaaccugaggucagcgguucccacacc

SEQ ID NO: 4196557 - RNA, 80 nt, Human
ggccuggguuugucagcaggcaggaggcaugccaggaguucuccuaggugucaggccuccuccagccgcuucccuuugcc

SEQ ID NO: 4196558 - RNA, 88 nt, Human
ggccuguauguuuuacgcagcugcuccaggaagcuguuguagaagcccucugccugcuccgugggcauugcuagguggaaaucaggcu

SEQ ID NO: 4196559 - RNA, 60 nt, Human
ggccugugcaagacagcaccccgcaacugcauaaaggucaaggggaugcugcuugcagcc

SEQ ID NO: 4196560 - RNA, 59 nt, Human
ggccuguggcaaggugagaaugacaaaucaauaucauugucauaguagaagccaagguc

SEQ ID NO: 4196561 - RNA, 74 nt, Human
ggccugugguuugauuaagcauuuuaccuuauuuuagaagggaugaugucugugagaucaaacuaagacagguc

SEQ ID NO: 4196562 - RNA, 90 nt, Human
ggccuguucucugggcagcccacguucuguccacgcuggcagcuuugagaugcccacaggagcugggucuugggccaggagacacaggcc

SEQ ID NO: 4196563 - RNA, 55 nt, Human
ggccuuaggcucaacaggcagagucaguugauaucuacagagugacccugaggcc

SEQ ID NO: 4196564 - RNA, 67 nt, Human
ggccuuaggggugaggcagaccucaacugcgaaaaguccccagggggcugcucccaccccugaggcc

SEQ ID NO: 4196565 - RNA, 58 nt, Human
ggccuuagugagguccugaugcagcccuggugaggcccuggggaggccuagugaggcc

SEQ ID NO: 4196566 - RNA, 69 nt, Human
ggccuuccaaagugcugggguuacaggcgugagccaccgcgcccagccacagucacuuucaucagggcc

SEQ ID NO: 4196567 - RNA, 62 nt, Human
ggccuuccacggagaacgaccgaggguauaaagugaaggcccugggcuuugcuggcaaggcc

SEQ ID NO: 4196568 - RNA, 88 nt, Human
ggccuucuggacugugaacuggcuuaguucuagaaauuuggugaaaagcuguacuucuccaucuacugacuuagccucauuucuggcc

SEQ ID NO: 4196569 - RNA, 92 nt, Human
ggccuucuggcuguggucagaggcuuuucuggucuuuggcugagccgugcagcucugggaauucagaaagccucugacuacaggacuaggcu

SEQ ID NO: 4196570 - RNA, 64 nt, Human
ggccuucuuuaguauugaguuaugguagccucuaaggcuccaugugaucugaagaauuauugcc

SEQ ID NO: 4196571 - RNA, 79 nt, Human
ggccuugcuuggguuauaugccauccuuggaucaauuacaaaagacagaauauggcauucuaggccaaaaucaggagcc

SEQ ID NO: 4196572 - RNA, 70 nt, Human
ggccuuggaaggacgggcuguaucugguaucagagucaccaggauagaugauccccauccacuccaggcc

SEQ ID NO: 4196573 - RNA, 60 nt, Human
ggccuugggcaaaguguuucuggagcaaaaaagaugcucagaggguuuuggccaagugcu

SEQ ID NO: 4196574 - RNA, 71 nt, Human
ggccuugggcagcaggcuccacguuccugcucaucgggagcccccaggaaucuugucuguugucccuggcc

SEQ ID NO: 4196575 - RNA, 69 nt, Human
ggccuuggguauagguggguauguaacaaggaaaauacauaaauaaacaaucaccugcauucuaggguu

SEQ ID NO: 4196576 - RNA, 58 nt, Human
ggccuuguagcagagggaugcacccugcaggguggaggugggugccugccacggggcc

SEQ ID NO: 4196577 - RNA, 84 nt, Human
ggccuugugugagcugggccugggauccuaagagaguuuuagcuuggacaucuggacgagccccagccccucucucacaagucc

SEQ ID NO: 4196578 - RNA, 65 nt, Human
ggccuuguguuuacaccugucuuugagcauuauagaagaaaaaagacagacggaaaccugaggcc

SEQ ID NO: 4196579 - RNA, 112 nt, Human
ggccuuucagcuuacagcagccauucuggagucauuggggcugaucgcauccugccagguguuccaucagauccuacugauugcuugcuuugauguauguucaaaaaagguc

SEQ ID NO: 4196580 - RNA, 60 nt, Human
ggccuuucaggugauccagggugagcguccccacagagccacccugcauacuggaaggcu

SEQ ID NO: 4196581 - RNA, 62 nt, Human
ggccuuugggcagugggcuuagcggcgugcaccaugccacucgggccacacgugcccuggcc

SEQ ID NO: 4196582 - RNA, 76 nt, Human
ggccuuuggugcagguugccugguaggugcgacacgcaggucuccucugggcugccugcacgggugggagcaggcc

SEQ ID NO: 4196583 - RNA, 60 nt, Human
ggcgaagggcuucucgccugugugcacgcgcuggugcaaaaagagcgaggagcccuggcu

SEQ ID NO: 4196584 - RNA, 66 nt, Human
ggcgaagggggugcauuugugaaugaaccagaauucugguucaaggaaacagcugaccccauugcu

SEQ ID NO: 4196585 - RNA, 77 nt, Human
ggcgaauggaugcuggucaguuuggcaaauucacugaaacucaucaagaacccagcugaacuugcauuccaacuucc

SEQ ID NO: 4196586 - RNA, 59 nt, Human
ggcgaauugaaaaaguauugaagguauuucaauacuuuuucaauacuauuucaauaguc

SEQ ID NO: 4196587 - RNA, 83 nt, Human
ggcgagagucauugcauucuuuaagccaguuacccauuuacaccugcaccgugauggcuuauggagagagcaacagacacgcc

SEQ ID NO: 4196588 - RNA, 61 nt, Human
ggcgagcagcgcugugucaggucaaagggagagaguuuuggggccugugaggccuuuugcc

SEQ ID NO: 4196589 - RNA, 113 nt, Human
ggcgaggccgccuccgcccacaccccugugcgcuccggcgagucagcggcaccgcccaggggccgcuggguuggggcggcgggggucgcgcuggguggccauccuaccucgcc

SEQ ID NO: 4196590 - RNA, 61 nt, Human
ggcugucucauaguuagagacacagagacaaguauauucucuguguccugaaaugaaggcc

SEQ ID NO: 4196591 - RNA, 62 nt, Human
ggcugucucugugacugccacccaaagaaucucucaccuggaacagagauagaaagacagcc

SEQ ID NO: 4196592 - RNA, 64 nt, Human
ggcugucuguuuuguauacaggccugggaaacuccucuggucuagaucaagaacagaacuagcc

SEQ ID NO: 4196593 - RNA, 79 nt, Human
ggcugugaacucccaguguuuacaguugaacaaaugauuuggccaucuguucagaauuguaacacucacaguucuugcc

SEQ ID NO: 4196594 - RNA, 66 nt, Human
ggcugugaaguucuuugcuccccaguaccaccaccuggcuaccugagcaagagcuucaaaacugcc

SEQ ID NO: 4196595 - RNA, 60 nt, Human
ggcugugcaguucaccaagcccucuccauacaucaaggcuuccuguggacauugcuggcc

SEQ ID NO: 4196596 - RNA, 88 nt, Human
ggcugugccagguuuucagaugcaauuaauuuucaagauaagcucuaaacuucugaaaugucuuugcaauugaaaugcugauacaguc

SEQ ID NO: 4196597 - RNA, 68 nt, Human
ggcugugcgucauccggcugcagauuaccaacaaaugugccagccagucaggcaugaccgcauacguc

SEQ ID NO: 4196598 - RNA, 90 nt, Human
ggcugugcuaaggucacacagcagccccggguguucacguguaugucuugagcacacacugggagcagcugugagccuggggucacagcc

SEQ ID NO: 4196599 - RNA, 55 nt, Human
ggcugugcuuugcccaaagggcugugguuucuuagcagucuugugacagccagcc

SEQ ID NO: 4196600 - RNA, 55 nt, Human
ggcugugggugugacaggccucugauuaauaggacuguccaauaagcccccagcc

SEQ ID NO: 4196601 - RNA, 55 nt, Human
ggcuguguccccaccugagcagucccaaccacaggcuccagguggagagacaccc

SEQ ID NO: 4196602 - RNA, 68 nt, Human
ggcugugucccccagauacaugcacagguguaugcaugugucugugggcacacacacacaauuuugcc

SEQ ID NO: 4196603 - RNA, 67 nt, Human
ggcugugucggugccaccugcuaugccugggcuuggugccacguggcagugccagcuccgacaagcc

SEQ ID NO: 4196604 - RNA, 82 nt, Human
ggcugugucuuuaaagcagcggugucuuuacugcagugugaguuuucacggcgguggacggacuccuugcuggacgucagcc

SEQ ID NO: 4196605 - RNA, 57 nt, Human
ggcuguguggccgugggcucuagcaccugccaggcgucaggagacccccacuacacc

SEQ ID NO: 4196606 - RNA, 99 nt, Human
ggcuguguuuuuguuggcgguauugcugcuggagccauuuuccguuuggagggcuccugauaggagaaugcgggucagcgaguuuagaacagcacagcc

SEQ ID NO: 4196607 - RNA, 106 nt, Human
ggcuguuaggcauucugucuguccugagcuggcuugucaaccagggcaugagugagucagacugcccugcagccggccagcucauuagucagccagccauucagcc

SEQ ID NO: 4196608 - RNA, 80 nt, Human
ggcuguuagugaguucugugagugagucuagcaaauuaucaagcccgagaguagccucauagacacucauucuuacagcu

SEQ ID NO: 4196609 - RNA, 69 nt, Human
ggcuguuccagagguuacugaggggcccccaaggaagagaggggcccagaguggccacuuggcucagcc

SEQ ID NO: 4196610 - RNA, 71 nt, Human
ggcuguuuacuuguaaguaacaagugagaaaugaaaacuaaguuaucucauugcuuacauaguuaugagcc

SEQ ID NO: 4196611 - RNA, 71 nt, Human
ggcuguuuacuuguaaguaacaagugagaaaugaaaaguaaguuaucucauugcuuacauaguuaugagcc

SEQ ID NO: 4196612 - RNA, 78 nt, Human
ggcuguuuguccuccuaguuccugccaguuguuccuaacgccguagccuggagggcucuagagaggccauccaaaucc

SEQ ID NO: 4196613 - RNA, 55 nt, Human
ggcuuaaaaggaaaaugagagucagaggcaaaaauuggcauguuucuuuuaagcc

SEQ ID NO: 4196614 - RNA, 88 nt, Human
ggcuuaaauaucagacccugaugagcuuuguuaguaugaaucaccuucccgaauaugcuaaauauguucacauugaugaaauuaaguu

SEQ ID NO: 4196615 - RNA, 68 nt, Human
ggcuuacacaugucucaguggaaaucgccaacgguuuuguuacauggcaguguuuaagacuaagagcc

SEQ ID NO: 4196616 - RNA, 83 nt, Human
ggcuuacaccuguaaucccagcuacucaggagggugaggcaggagauuugcuugaaccugggagguggagguugcagcgagcc

SEQ ID NO: 4196617 - RNA, 94 nt, Human
ggcuuaccauguuuguggagacuuuuauugguaaugauaaaaguugggcugacaacauuucuaucauccuguaauguaaugcacacacagagcu

SEQ ID NO: 4196618 - RNA, 55 nt, Human
ggcccuguuagagcucccacaaccuuccuguugcccuggucauggcuacagggcu

SEQ ID NO: 4196619 - RNA, 120 nt, Human
ggcccuuccuggacucacaucacagccacagcgcagccugggcuucuccuacuuccagcuccggacagcagggggaggcugugcugcgucuggcuguagauaugggugcagaaguggguc

SEQ ID NO: 4196620 - RNA, 67 nt, Human
ggcccuucuggaggacacuggccccauuuuucucuuggucccauuguucugcccaggacccaggguu

SEQ ID NO: 4196621 - RNA, 55 nt, Human
ggccgagccaggauuugaacccaggcaucuggcuucagagucugaguucuuugcc

SEQ ID NO: 4196622 - RNA, 76 nt, Human
ggccgaggugggcggaucaccugaggucaggaguuggagaccagccuggccaacguggugaaaccccaucucuacc

SEQ ID NO: 4196623 - RNA, 67 nt, Human
ggccgccagcgucucguugugggccucgcccgggguccgguuggcggccggcucggggcgcacgguc

SEQ ID NO: 4196624 - RNA, 65 nt, Human
ggccgccguggcaccugcucgcccuagcccugcaacaggccuagggucaggggccugcgucggcc

SEQ ID NO: 4196625 - RNA, 61 nt, Human
ggccgccuggguccaccgcucgcgcucccaggggagugggccggacagcccaggccccgcc

SEQ ID NO: 4196626 - RNA, 72 nt, Human
ggccgcgaggcugcggggaggagccugcacgagggcccggcagccccggcagcccccccagcccucggcgcc

SEQ ID NO: 4196627 - RNA, 71 nt, Human
ggccgcggauuggccugccccgagauccuggccacugauuggucgcccggacggggcggggccacguggcc

SEQ ID NO: 4196628 - RNA, 100 nt, Human
ggccgggaccgagggggagaggcugcgguggggaaaggaggugcuggggagaagggaagcccagaccgcuaccccucacccccuuuuccccagccuggcc

SEQ ID NO: 4196629 - RNA, 93 nt, Human
ggccgggauggucucgaucuccugaccucgugaucugccagccuuggccucccaaagugcugggauuacaggcgugagucaccacgcccggcc

SEQ ID NO: 4196630 - RNA, 56 nt, Human
ggccgggcaggucucagccagccugucccucccacauuccugaaaccugcccagcc

SEQ ID NO: 4196631 - RNA, 57 nt, Human
ggccggggccugcucgccugugcgggugaccacggacucgcuggggggccccuggcc

SEQ ID NO: 4196632 - RNA, 64 nt, Human
ggccgggguccgggcaguaggcugcaggcuucguccucugacagcagacagccuggccccugcc

SEQ ID NO: 4196633 - RNA, 67 nt, Human
ggccuacccgggagacuccucuagggcugugucgaggagggcagcccccaggagucuccacgccgcc

SEQ ID NO: 4196634 - RNA, 96 nt, Human
ggccuagauagccucucagcuuuuagaaccgagccuuccgagaugcuuggagaguucuaccucugaaggcgagcgggcacaaagaguagugggguc

SEQ ID NO: 4196635 - RNA, 76 nt, Human
ggccuauuggcagagcuuuacaggcuaucuaugaagaaaaauacacuguacgcucugcuucaaguaagguggugcc

SEQ ID NO: 4196636 - RNA, 59 nt, Human
ggccucaagcuacccucucaccucagccucccaaagugcggggauuacaggcuugggcu

SEQ ID NO: 4196637 - RNA, 100 nt, Human
ggccucagacuaauucacagcauuugcccaucugggauccuaccgcagauggcuggagguagaugcucacugaacagaguucaaaaaacacaaaggggcu

SEQ ID NO: 4196638 - RNA, 94 nt, Human
ggccucagcugaaggccuggcucugagccagccaccuccuucacacaacccaccuugcucugaagcugccugcucacagccaugccccgaugcc

SEQ ID NO: 4196639 - RNA, 76 nt, Human
ggccucagggaaucagacucugcagccagucagugucagagcugcacucugcuguucacagacucugcucuggguc

SEQ ID NO: 4196640 - RNA, 83 nt, Human
ggccuccaagccuggaggaggaguugagcacacagacgacugggguguucauuguuucuucuucuuuuggcuuguaaggugcc

SEQ ID NO: 4196641 - RNA, 71 nt, Human
ggccucccaaagugcuaggauuacaggcugggaucacacugugccuggcccuagcagcuuuguccugugcc

SEQ ID NO: 4196642 - RNA, 73 nt, Human
ggccucccaggagcuucucucugccucugaguugcuacagagcgugaggcccacgaggcaaguuccucaggcu

SEQ ID NO: 4196643 - RNA, 108 nt, Human
ggccucccaggcaguggauguucacagcugggacaagacuggggggcuacaaaaauggcugccaauagcuggucuuuaagcauguaacaaauaccuuccagggacucc

SEQ ID NO: 4196644 - RNA, 65 nt, Human
ggccuccucauugcucugaacccagggcaccauucuggcaugggucauggguggagcugggggcc

SEQ ID NO: 4196645 - RNA, 72 nt, Human
ggccuccuucuacaaagugcuuuagaaaugaaagggaacuuagagaggauugaauuuguagggagagaggcu

SEQ ID NO: 4196646 - RNA, 68 nt, Human
ggccucgggcacggaaggcgccaggggugcggguuccugcaaccccuuggaguccgcgcccagaggcu

SEQ ID NO: 4196647 - RNA, 112 nt, Human
ggccucuaguggaguuaggcuggcuguccuuucauccccagcuauacagggcuggauggcuguggguggaaggaaaccaggcaggcaccuucacccacuggggacacaggcc

SEQ ID NO: 4196648 - RNA, 63 nt, Human
ggccucucuugggacagcugucuuguaagacacugcugauucuccucaagacuuucgcgggcc

SEQ ID NO: 4196649 - RNA, 59 nt, Human
ggccucugcagagcauuauagcaaaagguuaacuacuuuucuagaggaucugcagagcc

SEQ ID NO: 4196650 - RNA, 73 nt, Human
ggcuuucuuggggcuccugcgccauucucccaggaaagugaggcgaaggugcuggcgccccaggagacgcgcc

SEQ ID NO: 4196651 - RNA, 55 nt, Human
ggcuuucuuguuaaauguccauuauucaagccuguggacaucuucuugggaggcu

SEQ ID NO: 4196652 - RNA, 91 nt, Human
ggcuuugaaguagagccaaugagcuuaacuuggccuguggggaaugccuggcagcugucuguggggucucuggccugcuuucaaaauagcc

SEQ ID NO: 4196653 - RNA, 77 nt, Human
ggcuuugaggcugggagaggcccugaagugacucauuuuccauuuguuuuucagacucaucucaagcuuuuauagcc

SEQ ID NO: 4196654 - RNA, 61 nt, Human
ggcuuugaguuccugcuauguccucuuaaacaaacaucaagagagccaggaacacacagcu

SEQ ID NO: 4196655 - RNA, 71 nt, Human
ggcuuugcugccucucccagcucccuggagacaguggagagagauaagccuggucgagagcacagccggcc

SEQ ID NO: 4196656 - RNA, 63 nt, Human
ggcuuuggaguuggcuacauauuucucuuccaagaugagcuguuugcuucaauuccagaagcu

SEQ ID NO: 4196657 - RNA, 82 nt, Human
ggcuuuggcagugcuuacaucguguuggaaagucaaaaccuaaaaaaccagauuauucaacaucauuguaagccucuaaacc

SEQ ID NO: 4196658 - RNA, 95 nt, Human
ggcuuuggcuuucuccauguuuuugcuggugaccucgugcagagcacagcagauggcugcauggacucaucagacaagauacuggggccauugcc

SEQ ID NO: 4196659 - RNA, 69 nt, Human
ggcuuugggcccucaagucuccuggguaccauggcugaaucuuccuggggcuguaggccgcccagggcc

SEQ ID NO: 4196660 - RNA, 60 nt, Human
ggcuuuggggguguccaagaaaugucaguugugggaaggauuuggagcaucccaaaggcu

SEQ ID NO: 4196661 - RNA, 64 nt, Human
ggcuuugguaagcuauggcuucuauacaucaagggcccccuuauauuggccauggugcaagguu

SEQ ID NO: 4196662 - RNA, 59 nt, Human
ggcuuuguggggugaaguaaagggaaugaacguggguccucagcccacccuuaggagcu

SEQ ID NO: 4196663 - RNA, 66 nt, Human
ggcuuugugguugacuggaggagcucuuguuuaccaaaauuuggagcuguuggcagcuaucuugcc

SEQ ID NO: 4196664 - RNA, 66 nt, Human
ggcuuuuaaugagcauuuuagaauugaagagccccaaguucaggauaucucaauguucagaaagcu

SEQ ID NO: 4196665 - RNA, 84 nt, Human
ggcuuuuagagaacuguggcuuucucugccuccuucuuggaauccacuuaccauguugagaggggcccaagccacauagaggcc

SEQ ID NO: 4196666 - RNA, 56 nt, Human
ggcuuuucaauaaaauccugcuucccuuggaggcagucuuugaaugugaaauaguc

SEQ ID NO: 4196667 - RNA, 65 nt, Human
ggcuuuucccaaaugcaaugaaaauugaguugaauuagucuuuauacaaacugggaaacauagcc

SEQ ID NO: 4196668 - RNA, 130 nt, Human
ggcuuuucuggacaaucaguggaagcaauagccauauggagaauauuuccaaaucuaauggaaccccuaccauuagacauagaauauugucuagcuggcauauuauucaauauccuguacauuaagagcu

SEQ ID NO: 4196669 - RNA, 74 nt, Human
ggcuuuucuuuggaggguaauacauuuuaaaacauuuagugugccaccuacugcuccacagugacuagagagcc

SEQ ID NO: 4196670 - RNA, 98 nt, Human
ggcuuuuugaaauguugguaacuauuaacuauuaccacucuagguuuaagauagaccguuuaagccccucuguagcuaauaguauaagagcaaaagcc

SEQ ID NO: 4196671 - RNA, 112 nt, Human
gggaaaaagcugaguguugggagggaaacugaggcagggcuugcauuuguccucuggaaugugucuagacuugcuggcuccuugcuucuagcccuucuagacuccuauuccc

SEQ ID NO: 4196672 - RNA, 67 nt, Human
gggaaaaagugguucagaaugccugggcagagccggagcuacagggauuccugccgcucgcguuccc

SEQ ID NO: 4196673 - RNA, 108 nt, Human
gggaaaacaggacaaccaggcaccuggggccacuugguggcagugugggcaggaacggcugcuaucuaggcaaggugguccagggugccaggagucauugcuauuccc

SEQ ID NO: 4196674 - RNA, 59 nt, Human
gggaaaacagggcugcugcucacccugcuugucccuggcacagaaagcugccuuguccc

SEQ ID NO: 4196675 - RNA, 89 nt, Human
gggaaaaggcuguuggcuuuucguuggucauuccccagcccauccccaggauccagcugcaagaaccaaggaaagaagccagccucccc

SEQ ID NO: 4196676 - RNA, 57 nt, Human
gggaaaauauuaagcaggacuucuaagcccaaagaagucauauuuauauaauuuccc

SEQ ID NO: 4196677 - RNA, 59 nt, Human
gggaaaaugcaguugaauuuggguaugacaccugucaacagcaaaggaaacaugcaccc

SEQ ID NO: 4196678 - RNA, 59 nt, Human
gggaaaauggccagugggguugagcaggacacagguccugcugugucuagcugguuccc

SEQ ID NO: 4196679 - RNA, 72 nt, Human
gggaaaauuacccagggauuaccaugugaaaauuacaucacagaaaauaguuaacucuugguaauagguccc

SEQ ID NO: 4196680 - RNA, 74 nt, Human
gggaaacccguuuaauuacucgagcugucaaaauguuuuauuguaaacagcuuuucugauagauccuguuuccc

SEQ ID NO: 4196681 - RNA, 63 nt, Human
gggaaacgauguagaagauguauugggucuguauuccaugaaaucauuuucucauugugcccc

SEQ ID NO: 4196682 - RNA, 61 nt, Human
gggaaagagagguggacgcaggucaaagauaucacauccucuccucucaccuuuccuucuc

SEQ ID NO: 4196683 - RNA, 76 nt, Human
gggaaagcagaagguuggggcuggaggucugcuggcaggcaggcagacauuuggagccaacuuuccugcucagccc

SEQ ID NO: 4196684 - RNA, 64 nt, Human
gggaaaggagcaugcguaccuucuucaguuucugcaccgcuggagggcauagcuguucuuuccu

SEQ ID NO: 4196685 - RNA, 59 nt, Human
gggaaagggaaguagagaggaggagccucagaugcucaggcucuguacucccuuugccc

SEQ ID NO: 4196686 - RNA, 68 nt, Human
gggaaaggugauagagacaagaaugggguugaugccugauauuccaugugcuugcucuggcaccuccu

SEQ ID NO: 4196687 - RNA, 87 nt, Human
gggaaagugaagccuggaggagcuggacgcggggaggccggggcaggaggggcuucucuggcuccugccggguccacacggucagcc

SEQ ID NO: 4196688 - RNA, 69 nt, Human
gggaaauacacuuccaaacuaaguuggggaggugcucccagaucauaguuuuuaaguguacaauuuccu

SEQ ID NO: 4196689 - RNA, 70 nt, Human
gggaaaucaguuuuuguuugccagauagcuauguauaucuagcuuuggagagucccacgaacuucuuccc

SEQ ID NO: 4196690 - RNA, 69 nt, Human
gggaaaugaacuguaaguggugaaauuaguuuugguauuuaauuuaaaacuacauuuauaguuuuucuc

SEQ ID NO: 4196691 - RNA, 109 nt, Human
gggaaaugguacaauaucaauauuaguguauuaaaaugcuccuaagaguaugcuaagauuuuuguuguuuuugguauauugguacuaaggguguuguugucauuuaccu

SEQ ID NO: 4196692 - RNA, 71 nt, Human
gggaaauucagguaauuugcagccacaguaaucuucacuauacugaaauguuaaauacuuggcuuuucucc

SEQ ID NO: 4196693 - RNA, 119 nt, Human
gggaguuuuuuuggagaaggagucuugcucugucacuaggcuggagugcaguggcacgaucucggcucacugcaaccuuugccucccagguucaagcgauucuccugccccaggcuccc

SEQ ID NO: 4196694 - RNA, 115 nt, Human
gggauaaguuggugaaagguuuagguguacaaaguaugaaccaguuucucucaggcuuauguucuuuuugccucaggaagcucauuuugacauauccccucacagacuauuaccc

SEQ ID NO: 4196695 - RNA, 83 nt, Human
gggauagauuccuucuccagaacuucuaggaauggaauugaaucuauuaugucuccagaacuucuagagauggauucuauucc

SEQ ID NO: 4196696 - RNA, 80 nt, Human
gggauaggggcuguggacuggcccugguauguguacugaggugaugaggguguggcagugccaugucugagccccuaccu

SEQ ID NO: 4196697 - RNA, 120 nt, Human
gggauagguguaggagguaggcccuuccuugaugauuuucccaggauagaccaucaucccucugggugaaggugaaugucuauggggaaggccuccaggaaccacccucuacauguuccc

SEQ ID NO: 4196698 - RNA, 78 nt, Human
gggauaguggguuuucaggcauguacuuuaccuguuaguuuagggagcugaaggcaaaacauguuacaccucugucuc

SEQ ID NO: 4196699 - RNA, 59 nt, Human
gggauaguuguguggggauucugguaguuucugagccaguuguaauccacaccuguuuu

SEQ ID NO: 4196700 - RNA, 60 nt, Human
gggauaucuggggacugaauuuagaguguuucccuuuucuaucuacuacuuagauauucc

SEQ ID NO: 4196701 - RNA, 71 nt, Human
gggauaugcuggauugagagcaaggggucccaccaucagaauaugacuccaccuuucccuauccuguuccc

SEQ ID NO: 4196702 - RNA, 62 nt, Human
gggauauuucacaggccagugguggggccuuuggcccuuggcccuucccugcuguggaaccc

SEQ ID NO: 4196703 - RNA, 82 nt, Human
gggaucacaagaaaugagguaguauuagaaggagagaugacagguucccuggaaggguacugauuuaacuugggugaaugcc

SEQ ID NO: 4196704 - RNA, 76 nt, Human
gggaucaccuucaucguauggccgaauguacauuguugauuucaaguauguuaagugagcuuaugaugaggguccc

SEQ ID NO: 4196705 - RNA, 76 nt, Human
gggaucccagagagguagcuuacccucuucugccacgugaggcucugacgagaagguggcuggcugucugugaccc

SEQ ID NO: 4196706 - RNA, 102 nt, Human
gggauccuauugccuuugcuuugugccccaagguauagaguuuggaaaaauaccagugcuggugguucuucuguuucggggaauaaagaaaaggaauacccc

SEQ ID NO: 4196707 - RNA, 61 nt, Human
gggauccuuggcugcaggccaaguuugccuagacucccuuggcacugagccagauggacuc

SEQ ID NO: 4196708 - RNA, 56 nt, Human
gggaucugaccaaggagacgucucucacccacugugcguccccuugagcagguccc

SEQ ID NO: 4196709 - RNA, 56 nt, Human
gggaucugaugcacugcugaaaaugaggucagauagcuaaggguagcaaagauccu

SEQ ID NO: 4196710 - RNA, 84 nt, Human
gggaucugcauaugugugggggcugggaaggaagccaggcccccugcagccaggccaagccuccccagcuccccaccgggucuc

SEQ ID NO: 4196711 - RNA, 113 nt, Human
gggaucuggccaguggguggcauaaauuugguggaccucaucagaaccggacauugcugucacggauuugacugagguccugccaggagucggccuuugcugccuccagaccu

SEQ ID NO: 4196712 - RNA, 55 nt, Human
gggaucuugcaugaaucaaaagaacgacacauguguuuucuuuucaugugaucuc

SEQ ID NO: 4196713 - RNA, 55 nt, Human
gggaugaaugccuggcucccccuucuuuccagcccuagcucaggcccaucguccc

SEQ ID NO: 4196714 - RNA, 67 nt, Human
gggaugaggcaagccagaggacugguggacagagaacuuucgucuucugaauauugucuuauuuccc

SEQ ID NO: 4196715 - RNA, 76 nt, Human
gggaugagguucgauacagcguauuuauugcuugucauguaaauuaaaaaccuuguauuuaacucuuuucaauccu

SEQ ID NO: 4196716 - RNA, 86 nt, Human
gggaugaguaauagguugugcagggcgaggaccugacauuaaaauaagucucagauuucuucuugcaacggcugcagauuuauguc

SEQ ID NO: 4196717 - RNA, 66 nt, Human
gggaugauucucauguucccugagaaugucaaggaauggcaauugagggaacaugagaaucaucuu

SEQ ID NO: 4196718 - RNA, 58 nt, Human
gggaugcaguauguauauuuucuaaaugaaaaguugaaagugggcaaccugcacuccc

SEQ ID NO: 4196719 - RNA, 65 nt, Human
gggaugccagagguuacuuugccuuggaacucuuccacgccaaaauuuguagcuucuucagcccc

SEQ ID NO: 4196720 - RNA, 72 nt, Human
gggauggaacacucgucaaauagcggguuuucuggaggcaggucccgugguggggaguggcuuccuuguccc

SEQ ID NO: 4196721 - RNA, 68 nt, Human
gggauggagagcuagugccugccaguagggcugcacgccugcgggugguuagguuggcucuuuguccc

SEQ ID NO: 4196722 - RNA, 85 nt, Human
gggauggauuuggaguugauaaaaugauaucuucuuuaugaaauagaaguaaggaguaucuguuuucucacccaaguauaguccc

SEQ ID NO: 4196723 - RNA, 55 nt, Human
gggauggcuuggagacagggccuguuuauaauuacagggauuuuccaggcuaccc

SEQ ID NO: 4196724 - RNA, 58 nt, Human
gggaugggagcagaggacgaccaguauccaaaaugguuggguagcugcguuuuaucuc

SEQ ID NO: 4196725 - RNA, 60 nt, Human
gggauggggaaagcccaaaacacccugcuggaagcgcugucucggggcuuucuccugccc

SEQ ID NO: 4196726 - RNA, 78 nt, Human
gggaugggguaagcccuaauugguaguguuugccaauuucucucguguaaauacucccaccauggcugauuucaugcu

SEQ ID NO: 4196727 - RNA, 70 nt, Human
gggaugguugaagggggcagagaaauggcauaugcuuuucucaaggcagggccucugucccccagcacuc

SEQ ID NO: 4196728 - RNA, 77 nt, Human
gggauguaaaugcagucucuacagcuccucugggccucuaaguguacagacuguauuuacaaguuuauaaaacuccc

SEQ ID NO: 4196729 - RNA, 61 nt, Human
gggaugugaaacacccuccaaugcacagggcaggcccugcugcagagaauguuuuggcccc

SEQ ID NO: 4196730 - RNA, 63 nt, Human
gggauguggcagcuggagguggagaagacuuuuuucucccuuccuccuccaccugucuuuccc

SEQ ID NO: 4196731 - RNA, 79 nt, Human
gggauguuaugugucuggcauggaaaguguuacuugcuuuauuaucuuaacaauccuguaagacagguaucaauauccc

SEQ ID NO: 4196732 - RNA, 60 nt, Human
gggauuaaaugaguagauacuuauaaagcacuuaaaauaaugucugcucauaauaaaccc

SEQ ID NO: 4196733 - RNA, 129 nt, Human
gggauuaagggagacuuagggcauuuaaggucugguggccuggcuaugacugucugugcuggcauaggcucuccuccccaggaccaucuauuuuauuuguucuggcuauuauuuauuccuuagaugguc

SEQ ID NO: 4196734 - RNA, 72 nt, Human
ggauugccccucuuccugaagagguuggucaggaaaauuuuuuguuaacuuuuauuuuagguuugagggucc

SEQ ID NO: 4196735 - RNA, 60 nt, Human
ggauugcuaugaggauggaaaaaacugaccaauguggggguauuuuacucauagcaggcc

SEQ ID NO: 4196736 - RNA, 71 nt, Human
ggauuggagacacagcaauaacuacuguugccauggaaggguuaacaguguaggagcugguuuaucagucc

SEQ ID NO: 4196737 - RNA, 62 nt, Human
ggauuggaggagcugcugaggguuggguuacaagggccaggggugcucugguuccuucaacc

SEQ ID NO: 4196738 - RNA, 73 nt, Human
ggauuggcuugcacuguauuuuaagggcuuauauuuggaaucucucuuuaaaauauuauaguucaaccaauuu

SEQ ID NO: 4196739 - RNA, 77 nt, Human
ggauuguguccagauuguuuuugcuggggugaagagugaauaucuucuagggaaaggauuuacaguuugauauagcc

SEQ ID NO: 4196740 - RNA, 93 nt, Human
ggauuuaagguugaccuaauaugguuuaguuuaaugaguuuuggacucagggcuuuauuucacuguaccauaaacacucaaauucuaaaauuc

SEQ ID NO: 4196741 - RNA, 62 nt, Human
ggauuuacuaucuugaaauauauggaaaauacacucagauauauuguagggaaaguaaguuc

SEQ ID NO: 4196742 - RNA, 57 nt, Human
ggauuuagaguucuaaggacggguuguccagcgcagcccagcagagaaccuaggucc

SEQ ID NO: 4196743 - RNA, 84 nt, Human
ggauuuaggugaggcauuuuguaacaaguaaauaucacugaacuaguuuuucagaaauaucaguugaaagugcucaucagaacu

SEQ ID NO: 4196744 - RNA, 57 nt, Human
ggauuuagguucggguaguugggagaaguagauguuccagcagagcccugaagaucc

SEQ ID NO: 4196745 - RNA, 62 nt, Human
ggauuuaucugcucuucgcguugaagaaguacaaaaugucauuaaugcuaugcagaaaaucu

SEQ ID NO: 4196746 - RNA, 65 nt, Human
ggauuuaugcauaagacacgcacaaggcuuuacuuuuuaauugugauuuacuucuggauaaaucc

SEQ ID NO: 4196747 - RNA, 79 nt, Human
ggauuucauaagacuuaggucgaguuuggcuuuuaguugugccugccgccuaucgaacucuuaauucauuaugucaucc

SEQ ID NO: 4196748 - RNA, 57 nt, Human
ggauuuccaaccagaaagguuccucucaaaucuuaagagcuuucuccuuggagcucc

SEQ ID NO: 4196749 - RNA, 58 nt, Human
ggauuucuaguaagucaugaaggcuuaaugcugugucuuugugaaaggacugaagucu

SEQ ID NO: 4196750 - RNA, 63 nt, Human
ggauuucuuuuggaaguuaaucaaagaauucagcugccacuuuaaaaguuccacaagagaucu

SEQ ID NO: 4196751 - RNA, 127 nt, Human
ggauuuguuccccuggaauauuauagauuauauuuuauguuggaauuacaucagugugcagagcagcagaaggcuggcuuaauguagcuaaaaauauaccuugacuuuccacuuggaauagaacucc

SEQ ID NO: 4196752 - RNA, 70 nt, Human
ggauuuuaucaaucuaugucaucaugaccucugaaauccaaccuuuggucaggagcauauauugaugucu

SEQ ID NO: 4196753 - RNA, 86 nt, Human
ggauuuucuacuaacugaaaaugucuagaaucuagaauauuucacaaugaauguuucagagcacugggcuuaucuuuugggaaucu

SEQ ID NO: 4196754 - RNA, 109 nt, Human
ggauuuucucuagaagacauacuggccuuuuuagaaaacagcuucuggcaugcaccaagauauuuugugacucucagcucuuugagaaggcagugugucucagaaagcc

SEQ ID NO: 4196755 - RNA, 58 nt, Human
ggauuuuucuuaugcucuucucugcacgucugcacaaagaaggcaaaagcagacaucu

SEQ ID NO: 4196756 - RNA, 69 nt, Human
ggauuuuuuucucuuauaaaaucucuguuguacacuuuaugacaggauggagauaauagaaaaaguucu

SEQ ID NO: 4196757 - RNA, 73 nt, Human
ggcaaaaaaguucaugguguuauagaaaaguaaacauuuuucacuuaaugaaaccaugagcuuuucaugugcc

SEQ ID NO: 4196758 - RNA, 78 nt, Human
ggcaaaaaaugcaagaguaaauucaggacuuuaaggcuacugucuugaaguuaaagaagaguucauucugcacuuguc

SEQ ID NO: 4196759 - RNA, 70 nt, Human
ggcaaaauauagugugaugaaaucauuccuguugaaugacuaacaggaugagaauaucauauuuuuuguu

SEQ ID NO: 4196760 - RNA, 56 nt, Human
ggcaaacaccaggcgagggagcaucccuaaccagcucaaugugucugcuguuggcc

SEQ ID NO: 4196761 - RNA, 83 nt, Human
ggcaaacgggugguuucucugcagagccccaaggaucucaucucuuucugguuauguauagagaucuugccaacucuguugcc

SEQ ID NO: 4196762 - RNA, 80 nt, Human
ggcaaagcacagagccuggaggaaaacaacugcagacagaauccuuuguuuugguuuaauuucuucuacugcugcuuuuc

SEQ ID NO: 4196763 - RNA, 79 nt, Human
ggcaaagcagugggcaaggaugagcccuuagaaggccuucagagccuugcugaccaucaccuuugaacacaugcuggcc

SEQ ID NO: 4196764 - RNA, 66 nt, Human
ggcaaagcccugccugguucaagcuagagagaaacagaaagagcugaauuaaggaagggcugugcu

SEQ ID NO: 4196765 - RNA, 55 nt, Human
ggcaaagccuuacucuaacugaucaaaugaccaaucagcuggauucaggcuuuuc

SEQ ID NO: 4196766 - RNA, 60 nt, Human
ggcaaaggcuucuuugcaggcuuuaggcuucuguuuaaaguugcaaagacagccauuccc

SEQ ID NO: 4196767 - RNA, 72 nt, Human
ggcaaagguguucaaggaaagccugccugucaagaauuaggcagagcuggguuuugaaaugccaucucugcc

SEQ ID NO: 4196768 - RNA, 89 nt, Human
ggcugccagaggguccugggcacagggcaggccgggcuuccucagggaccccgcccuuggccucuuuggcccggcggaagaugucagcc

SEQ ID NO: 4196769 - RNA, 73 nt, Human
ggcugccagcagcugcaaauggaaacagcgggccacaugcagccucugccguugacagcuguggguggcaguc

SEQ ID NO: 4196770 - RNA, 69 nt, Human
ggcugccagggguggguguggucagugccaagagcuguccuuaccccaucacaucucaccacugcaacc

SEQ ID NO: 4196771 - RNA, 75 nt, Human
ggcugccagugggacccgcugugggcagggggauuucuucccagaguccaggcuaagucccuucugccuucagcc

SEQ ID NO: 4196772 - RNA, 68 nt, Human
ggcugccaguuugauucgggccacugugauauccuggccuaacagugcccugacacaccuggugugcc

SEQ ID NO: 4196773 - RNA, 81 nt, Human
ggcugccauccuucaguuaucacaguacuguaccuuuagaauagacagcaucagcacugugauaacugagccagggcagcc

SEQ ID NO: 4196774 - RNA, 91 nt, Human
ggcugcccgaccccagucccauggagaagacuugagcuugcugaauuauggacagcaggugucacuuucacuccaagacugggcucccacc

SEQ ID NO: 4196775 - RNA, 77 nt, Human
ggcugcccuagaaguacagagagcaguuguugcauaguuaagcgaaaaggcagcauuuuaugucugauagagcaguc

SEQ ID NO: 4196776 - RNA, 55 nt, Human
ggcugccgggugagggccgggcuggcucacucuuggccacuaccaccuggaggcc

SEQ ID NO: 4196777 - RNA, 128 nt, Human
ggcugccuggacucacugggcugggcugcagggugaggucagcauuugcugugagcucaucugagcugggagcucccagcagagcuggccacugcucuggccaccuugugcaggagcuggaggaaguc

SEQ ID NO: 4196778 - RNA, 90 nt, Human
ggcugccuguuuauucuucuagcucccugagaugccacagcaagcaggagcccugcuggugcauccucagggucaccaggggacaggccc

SEQ ID NO: 4196779 - RNA, 67 nt, Human
ggcugccuguuuggcaucauugguuguugccuguuuggcaucggccuugacaagcuuagcagcaguc

SEQ ID NO: 4196780 - RNA, 76 nt, Human
ggcugcggaaggcugccuggcuugagcaucuuaacagcgcccaaguuuaugguucagcagugcagccccggcaguc

SEQ ID NO: 4196781 - RNA, 55 nt, Human
ggcugcggccgcgggucugugcagcagccggugcagggaccguggaguagcagcu

SEQ ID NO: 4196782 - RNA, 75 nt, Human
ggcugcggcuguggagguaccaccuguggagaaacugcaaagaugcugucugugugugucuccgcggccguagcc

SEQ ID NO: 4196783 - RNA, 72 nt, Human
ggcugcgucgagacagccuggcaccccaggggucaccauggaggccuugcccugcuguggcucugcccagcc

SEQ ID NO: 4196784 - RNA, 61 nt, Human
ggcugcuccuuuacccuggcagcaggauaagaagauguggugcacagggcccaggagagcc

SEQ ID NO: 4196785 - RNA, 114 nt, Human
ggcugcucggcaccuggccucagcaggugaacaucaugccagauuccuugucagauucaaggccaagugggugaaugucaugugcaguguugugccagguaugugccgggagcc

SEQ ID NO: 4196786 - RNA, 79 nt, Human
ggcugcugaugaguccuucuaucgcaggcugcagcaguccugaagguugauggagggccaugcuauucaaacagcaggc

SEQ ID NO: 4196787 - RNA, 64 nt, Human
ggcugcuggccagccuaggaguggguccccucaggucagacacacccugggcaggucagcagcc

SEQ ID NO: 4196788 - RNA, 81 nt, Human
ggcugcugggagcuaggcugggcaggaaauaugcagaugagcgaagauuugcacauuucuuagccuaguuccaguccagcc

SEQ ID NO: 4196789 - RNA, 111 nt, Human
ggcugcuggguggagacgaggcaugugggaugcugcacugagcucucuagggcauaggagagcaggccagccgucccagggagcagugccugugccuccuccagugcagcc

SEQ ID NO: 4196790 - RNA, 55 nt, Human
ggcugcuguaauuuuguuuauaccacagguuggguggcguaaacagcagacaguu

SEQ ID NO: 4196791 - RNA, 94 nt, Human
ggcugcuuuagauuuuuaugucucuaagauucuuggucugguauugggugggaugccagggcauguccaagacuuagaaaagaucaccauaguc

SEQ ID NO: 4196792 - RNA, 63 nt, Human
ggcugcuuuggcuggggcccuacuuucuugcugaaggcuggcuucccucaggucugagcaguc

SEQ ID NO: 4196793 - RNA, 69 nt, Human
ggcuggacaagcuuggucuuccgccaugcugcucacacagaagcaggcucacgccaggcagugccaguu

SEQ ID NO: 4196794 - RNA, 92 nt, Human
ggcuggacauggcuuaugggcuacgguuugcugauccuugacuuagaucuaagcugcaaccuuagcuauaggcuuauuuuugaguuccagcc

SEQ ID NO: 4196795 - RNA, 113 nt, Human
gggaaggaaggaggugccaagcccuccgcucaguggaggucaguggagguuugcuuccugcucacacugggccugauugggucggagggcacgcgggggccgcugucuguccu

SEQ ID NO: 4196796 - RNA, 130 nt, Human
gggaaggcauaauuguguuuugaaaugugagaaacaggagauuugggagggaccagggguagaaugauauagucuggcucuguguccucacccaaaucucaucuugaauuguaauacaaauuauaauccc

SEQ ID NO: 4196797 - RNA, 86 nt, Human
gggaaggcggacagggcuguaagagguuuggaggcugguggccguguuguuuggguccuugugucucuauggcccugccccuuucc

SEQ ID NO: 4196798 - RNA, 75 nt, Human
gggaaggcggggucagcugagggcagccuccuaggucugacucaggucuagaggauguuccuuuccugccuuccu

SEQ ID NO: 4196799 - RNA, 64 nt, Human
gggaaggcuuccuggaggagguggccucccagagcucagcuuguccuuccuugagguccuuucc

SEQ ID NO: 4196800 - RNA, 62 nt, Human
gggaagggaguggcagggugagagcaggcaggacugaugagacuuugggcacuuuccugccc

SEQ ID NO: 4196801 - RNA, 65 nt, Human
gggaagggcuuucugggagaagagacacuuaaaacugaguccucuggacugaggaggcuuuugcc

SEQ ID NO: 4196802 - RNA, 81 nt, Human
gggaagggggaggaaugaaguauccuaaguagcaaccauggcugcgcugcuggaggccugacuguguuucuuucccuucuc

SEQ ID NO: 4196803 - RNA, 99 nt, Human
gggaagggggccgcugugccgcugagaguucguuccacccuccuggcagugcuggagggggcuggagcucuggcgucuggccuagugacccuaccuccc

SEQ ID NO: 4196804 - RNA, 61 nt, Human
gggaagugagcuggaaucaagggcacaauuuggccaccuacauaucuggaccucacuuucc

SEQ ID NO: 4196805 - RNA, 60 nt, Human
gggaagugggcuuuguggucagcuuccauagugaaaaguugguucucagagccccuuccc

SEQ ID NO: 4196806 - RNA, 72 nt, Human
gggaaguugaaauuccaggagaguuaaaauaccccuuuauacggguguuuuaugcuuauggaguuuuauccc

SEQ ID NO: 4196807 - RNA, 80 nt, Human
gggaaguuuagagguuggggacuuugcagguuagggacgucacauaaaggcuucagaggaaacaaucuuuaguacuuucu

SEQ ID NO: 4196808 - RNA, 74 nt, Human
gggaauagcuaccuuuauggagaacuugggauguauuauacaagaugcuaagugcuucacaaauguuaucuccc

SEQ ID NO: 4196809 - RNA, 70 nt, Human
gggaauaguucaggguuauuucaaggucagauucacuucaugaucagaaacguuaccuagggcuguuccu

SEQ ID NO: 4196810 - RNA, 77 nt, Human
gggaauauagcaguugguuagaacaaacaauuuucuuaaauaggaaauguacuuuaaagccauccugcugugauccu

SEQ ID NO: 4196811 - RNA, 83 nt, Human
gggaauaucguugcucauguaguauguaggguuggagagcacaaccacugucuggucugucccacucugcccuugagcuuccu

SEQ ID NO: 4196812 - RNA, 73 nt, Human
gggaaucaggacagugaaugagaauggagaaaugggaacaaaugcauuuaguauucucuauuuccaucuuccc

SEQ ID NO: 4196813 - RNA, 100 nt, Human
gggaauccgauuuucccagguccagccaggugcucaugccugggaucauucagcuaugauuggguuggcagagacuggguuggcagaggaagggguuccu

SEQ ID NO: 4196814 - RNA, 113 nt, Human
gggaaucugggagcccuaaggggcagcucuucccucuucuuguaggcaggacucagguucucacugcagcuuaagggagggguugccugugugaucgcugacccuggagucuc

SEQ ID NO: 4196815 - RNA, 79 nt, Human
gggaaucuuugggauccugauuuacucuagaauacaacuuuggcuaaauugagaaguaggugcagugacucgaagaccc

SEQ ID NO: 4196816 - RNA, 56 nt, Human
gggaaugaagucuagcaagcauugaauuuuuaaguuugcuuuucugauuuuuuccc

SEQ ID NO: 4196817 - RNA, 56 nt, Human
gggaaugagggagccggcagugaauuuucaugaggcaaaggcuucuuuuauucucc

SEQ ID NO: 4196818 - RNA, 60 nt, Human
gggaaugggagguggccugucucugucucugcguggagagacacugccacuucuguuccc

SEQ ID NO: 4196819 - RNA, 64 nt, Human
gggaauggucacuuugggaacugggagcuuagcacacuaggcuccaagucucagagugaagccc

SEQ ID NO: 4196820 - RNA, 107 nt, Human
gggaaugguugauacaugacaugugacagcaggauuacuuuaucagguaaaggaauuacuaaaugaacuauuaauacuuggaguuauugagucagguuaaaguuucc

SEQ ID NO: 4196821 - RNA, 67 nt, Human
gggaauguguauacuggcaauuaagauuguuaguacuuaacugacuuccuccagaauacauguuccu

SEQ ID NO: 4196822 - RNA, 62 nt, Human
gggaauguuuuuauaaguguuacauugucauacaggcuguaucuuagugugaaaauauuucu

SEQ ID NO: 4196823 - RNA, 98 nt, Human
gggaauucugagaugugguaggauagugacuuauaugcauuuuuaagaucauaugcaauauuagaacaucauuuugcaacuuaaaaauuauaauucuc

SEQ ID NO: 4196824 - RNA, 62 nt, Human
gggaauuuaugagaauaauuaguuuuguguugcuuauauuagagcugguuaucuuaauucuu

SEQ ID NO: 4196825 - RNA, 66 nt, Human
gggaauuucuuucaaguuuugacuuaaccccaguauugagccaaugauuugaauagagcagguccu

SEQ ID NO: 4196826 - RNA, 71 nt, Human
gggacaaauaggucaacaggagggauuggcgccgugcaugucauaaaaccccuccaggccugucauguucc

SEQ ID NO: 4196827 - RNA, 95 nt, Human
gggacacacugguccaguugcuguuguccaucuguugccauaagaacaaaaagaauuaguucuauagacuuggacauauagucacuguugugccc

SEQ ID NO: 4196828 - RNA, 92 nt, Human
gggacacaugccaccucugcucacauuucauuggccaaagcaagucacauggccacccccaaugucaguagggugggaaauaugauuguccu

SEQ ID NO: 4196829 - RNA, 88 nt, Human
gggacacuccaggcaguggcuugucccaaggugcuggaacauucugaccagccagugggauuagagccucuauaaccugggugcuccc

SEQ ID NO: 4196830 - RNA, 64 nt, Human
gggacagaaggaagugagcacacggcacacccgcuguuggauugguugcuauuucucccguccc

SEQ ID NO: 4196831 - RNA, 96 nt, Human
gggacaggcaaagaggaagagagcucugccuuguccugucuccucugcuugugacuuggacaaggcagagcgcuuuucaggagguugcaugguccc

SEQ ID NO: 4196832 - RNA, 84 nt, Human
gggacaggguaguucuagagcucugcuacucaaaguaugguccuuggccucacaguuucacaguguagauaugcccucuguccc

SEQ ID NO: 4196833 - RNA, 107 nt, Human
gggacaggguuuuugcugcccggggccuagucuaccucggcacgcuuuucucugaaggagacacgcacuugcacgacgugggccucugugcagcucuacuuuguccu

SEQ ID NO: 4196834 - RNA, 75 nt, Human
gggacaggucugguuuccuucaggcacaacuggauucauggaucguaaugcugccuuugggaccuggccugucuu

SEQ ID NO: 4196835 - RNA, 58 nt, Human
gggacaggugcuaagggaccuggcaggcagggcuggcaggccccauggcgccuguucc

SEQ ID NO: 4196836 - RNA, 55 nt, Human
gggacaggugggccaugaaaaaugaccaucaccuuggcuauaucacccccguccc

SEQ ID NO: 4196837 - RNA, 94 nt, Human
gggacauggagccacacugcccuaacagugggcuggggucugccuccuggucuacacugcauuggggaugcuuugacagggugcuucauauucc

SEQ ID NO: 4196838 - RNA, 105 nt, Human
gggaccaagaucuagaaagagggggcaugaaaugagccuggagaugcauguggugacauguuuccucuaaacgcauuugcuuaucuucauuagaucuagaggccc

SEQ ID NO: 4196839 - RNA, 101 nt, Human
gggaccacacacagauccccgauuucaguaaggauaauaaacagaccuacguggagugagggugugauauuuucuuauugaaguugcuguguuuuugugcc

SEQ ID NO: 4196840 - RNA, 130 nt, Human
ggcauuuuuaacaucuggguggugacccugcugccaucagaguucaggaauugcugagaggagaagcagcaccuguucccugggucucugcaguggcagcagcugagaugguaauaggugugcugaugcc

SEQ ID NO: 4196841 - RNA, 71 nt, Human
ggcauuuuuauuggaauuucacugacucuacugauuaauauaaggagaacugacauuuccaauauaaagcc

SEQ ID NO: 4196842 - RNA, 86 nt, Human
ggccaacaggaguucaaggcucuggaccaaaucccaucacuaaauugcugugggaucuugaaucaguggcacaagauuugggggcc

SEQ ID NO: 4196843 - RNA, 62 nt, Human
ggccaagaaacuauuuauuguggguauccaggcugugucuguaugcacaaaauauccuggcc

SEQ ID NO: 4196844 - RNA, 60 nt, Human
ggccaagagacacuguguacagaaaaagaaaccaauuuccuggcggcacugucuugggcc

SEQ ID NO: 4196845 - RNA, 63 nt, Human
ggccaagauggaaggagagauggccguucguccagcucccagccucucuccaucucaguggcc

SEQ ID NO: 4196846 - RNA, 68 nt, Human
ggccaaggaugguggcucugguaaaucucauacucuaguaauggagcuccccaggcuacuucuuggcc

SEQ ID NO: 4196847 - RNA, 79 nt, Human
ggccaauccauauauauaguuuauauagaaugucucuuuacaauaacuguaugcaauaauaacuauguggcuguuggcu

SEQ ID NO: 4196848 - RNA, 60 nt, Human
ggccaauggcagagccuugccaaacucccgacacggcuguacaaggccucugccaucacc

SEQ ID NO: 4196849 - RNA, 55 nt, Human
ggccaaugugcuccacgccagagcccaugugcucuauggucuggcccacaugguc

SEQ ID NO: 4196850 - RNA, 104 nt, Human
ggccacaaggacagauuccugggagagcugcccgggugauugcccuuacuguggucacacugaauggcacugacauucccagguaccuacacucuuuucuggcc

SEQ ID NO: 4196851 - RNA, 65 nt, Human
ggccacaauggacuggaccagugaguuaaggguaacuuuugcuuuacuuugccauucguugggcu

SEQ ID NO: 4196852 - RNA, 97 nt, Human
ggccacaguuuacugguguaugaagcuauauuguuggcuguauuguuacucuggcagagcuguagacuucccuaucccagugguauuagacuuggcc

SEQ ID NO: 4196853 - RNA, 80 nt, Human
ggccaccacugaucuguuuccauacagguuuuuggauauuucuagaauaucauaugaagagacucacuuaguauguggcc

SEQ ID NO: 4196854 - RNA, 82 nt, Human
ggccaccucuggcaccacugagucugcaguuaguucucacccaccacgcccugccugaccucagugucugcuucaggcugcc

SEQ ID NO: 4196855 - RNA, 69 nt, Human
ggccaccugcgggccgugguggagaagggccaggguacgguauugcuccacaacagugugccuguggcc

SEQ ID NO: 4196856 - RNA, 68 nt, Human
ggccacuaugcaggugcuggggaugcgauggccauaaaaacugacaugcuuccacagagcuugcagcc

SEQ ID NO: 4196857 - RNA, 99 nt, Human
ggccacucagaggggaucugagcucugggaguagggccaguguucuccuagcagaguugggagccuggcuccuaagagcacaacaccucugucugugcc

SEQ ID NO: 4196858 - RNA, 83 nt, Human
ggccacugccaacuucucccugaagaaacaaaaacacaugauuaguugaccauucucaggguagaggugacacuggcauggcc

SEQ ID NO: 4196859 - RNA, 76 nt, Human
ggccacuuaccucccagagaugcugcguguuccucacggcgccugccugcaccuucucugggggcagaagcacgcc

SEQ ID NO: 4196860 - RNA, 76 nt, Human
ggccacuugaccccccauccucacuugcggccacacagcacgugucacaggacccugaggguggcggggccaggcc

SEQ ID NO: 4196861 - RNA, 61 nt, Human
ggccagaaaguuaagcuguggcccuucagaguuuuauagggcccagcacaaucuucuugcc

SEQ ID NO: 4196862 - RNA, 58 nt, Human
ggccagaggaccucucauagcccuuuuagguuguggauggaccuuccuucuguuggcc

SEQ ID NO: 4196863 - RNA, 74 nt, Human
ggccagaggagaagguggaaaccagaagagcacucacugcugcucagacucuggccacuugcuucacacuggcc

SEQ ID NO: 4196864 - RNA, 63 nt, Human
ggccagaggucuccugcacgggaugugccuucucaauauccucucagggccaguaccucaccc

SEQ ID NO: 4196865 - RNA, 70 nt, Human
ggccagcaaaagagggaaacagauggguugugggagaugacccugcccccaugcuguuuuuguucuggcu

SEQ ID NO: 4196866 - RNA, 60 nt, Human
ggccagcugccaccagcccuauggugugaauggcaaggaaguggggacuggcggcuggcc

SEQ ID NO: 4196867 - RNA, 61 nt, Human
ggccagcugccugaccuucuguucagugacccuuuuuguacaaagucaaauugcagccgcc

SEQ ID NO: 4196868 - RNA, 62 nt, Human
ggccagcugugggauuuucugcuuggguguaagcaaugggcagguaagggacacaccuggcu

SEQ ID NO: 4196869 - RNA, 68 nt, Human
ggccaggaaggccuggaugcccccugccuacuaagucccuggcucgggggaggaagagccguccugcc

SEQ ID NO: 4196870 - RNA, 101 nt, Human
ggccaggacaugcaagcugauuuuccagaaagaguagcccugggcgggaaggaccccagguggugcugaauucuggaggaggcuggucugucuuggacacc

SEQ ID NO: 4196871 - RNA, 62 nt, Human
ggccaggaccugcuuuguaaaauagacauaaauacauuuuaugcuuacaaaauaucuuggcu

SEQ ID NO: 4196872 - RNA, 64 nt, Human
ggccaggagaggagggcacugauagggacugaauuagaaccccgguucucgccucugcugcucc

SEQ ID NO: 4196873 - RNA, 65 nt, Human
ggccaggaggggacagggcugugucgccccauguggguggggcugggcugugcccuuccguggcc

SEQ ID NO: 4196874 - RNA, 57 nt, Human
ggccaggaggggcguccugagugggccuguggaaugggccccgcguccugccuggcu

SEQ ID NO: 4196875 - RNA, 93 nt, Human
ggccaggauggucucgaucccccgaccuugugauccacccaccuuggccucccaaaguguugggauuacaggugugagccaccgugccuggcc

SEQ ID NO: 4196876 - RNA, 93 nt, Human
ggccaggaugguuucugucacuugaccucgugauccgcccuccuuggucucccaaagugcugggauuacaggcgugauccaccauaccuggcc

SEQ ID NO: 4196877 - RNA, 67 nt, Human
ggccaggcuggucucagacuucuguccucaagugacccacccaaagugcugggauuagucaugagcc

SEQ ID NO: 4196878 - RNA, 56 nt, Human
gggcauggccaggugagggguccaugcagaguacaugacccagcaaggccaagucc

SEQ ID NO: 4196879 - RNA, 86 nt, Human
gggcaugggguaaacuacuuacagucuggauuaggaaacauagaaacgaauuuauuaauuaaugugccagauugugucuagugucu

SEQ ID NO: 4196880 - RNA, 57 nt, Human
gggcaugugaucuuucaggcaaaucaaccaaaguaaugcuggaaugagaacaugccc

SEQ ID NO: 4196881 - RNA, 78 nt, Human
gggcauucucccucuaugugugccugcguccagauuucuucuccuuaucaggacaauggucauacuggauuagagccc

SEQ ID NO: 4196882 - RNA, 69 nt, Human
gggcauugucacagaggcuuugcgggucaggccucuggacucgagucccuggcccacauggcuucuccc

SEQ ID NO: 4196883 - RNA, 55 nt, Human
gggcauuguggguaagaggaaacgcuggggccggcccgcucccccccacgugucc

SEQ ID NO: 4196884 - RNA, 68 nt, Human
gggccaagagcugccuggauucaaagcucaugugagcacaugcagacgggauccuggcaguuacaccc

SEQ ID NO: 4196885 - RNA, 82 nt, Human
gggccaagcuggccucucagaccaaacuguccgaugcaaaucuagaauccccagaggguggaggccaggcucuacuaggccc

SEQ ID NO: 4196886 - RNA, 62 nt, Human
gggccacaguguucuuuuuaaaauuuguugagaugccccuugaaagaaugcuguguauuccc

SEQ ID NO: 4196887 - RNA, 79 nt, Human
gggccacauaacaaccucuaucggucaggaagccuuugaucugggccaggcugccgacccacagggguuaauugugccu

SEQ ID NO: 4196888 - RNA, 56 nt, Human
gggccacaugacuugcuguagcacccuguaaggacagcacccaugucaucuggcuc

SEQ ID NO: 4196889 - RNA, 63 nt, Human
gggccacuauuuauuaacaggauugcuacuuauggggcaauucuguguuaggauagauggucc

SEQ ID NO: 4196890 - RNA, 75 nt, Human
gggccacuuccaggaugggcuguccuacucuguuuucaagaccaucacagaccagguccuaauggguguggaccc

SEQ ID NO: 4196891 - RNA, 55 nt, Human
gggccagaccucuucucagggaagaccgcgggugucagggaagaggaucuggccc

SEQ ID NO: 4196892 - RNA, 71 nt, Human
gggccagccgcacugggccucauuccuggagggcccugucucucggcaguguugcuaggugcggugagccc

SEQ ID NO: 4196893 - RNA, 60 nt, Human
gggccagcucugugauguaggggaagaaaaauauguuccuucuacccuucuaggcugccc

SEQ ID NO: 4196894 - RNA, 69 nt, Human
gggccaggcaaagcccaugcaagaguguguggaagugagcuggagcccucuucagggcuuguguggccc

SEQ ID NO: 4196895 - RNA, 88 nt, Human
gggccaggcuaaggguggcucaguuccaucaucuggaggucagacacacuguccagaggcagaacugaagcccucucggccccuaccc

SEQ ID NO: 4196896 - RNA, 74 nt, Human
gggccagggcagcacucccaggagaaccagcaucuucaugugccaggguccccuugggaggugagucugggccu

SEQ ID NO: 4196897 - RNA, 80 nt, Human
gggccaggguguagggauuccagauggaagcaaaagacacacucaccaucuggauaggaaccucugcuugacccaggccc

SEQ ID NO: 4196898 - RNA, 68 nt, Human
gggccagguaucgucuuuaguagcuuauggaaaaugugccagaccaauggcugagggaugccugguuc

SEQ ID NO: 4196899 - RNA, 60 nt, Human
gggccaguucuccgccucuuuuaacuuuacugccaaggcaggagagggguggaguggccu

SEQ ID NO: 4196900 - RNA, 62 nt, Human
gggcccacagggccuggggcagcugcucaauuggcagcuggggcagugcccugugaaggcuc

SEQ ID NO: 4196901 - RNA, 80 nt, Human
gggcccaccagugucaccccaaccaggacaacuggaccgucagccagauccugggcgaguggugguacacucuggggccc

SEQ ID NO: 4196902 - RNA, 99 nt, Human
gggcccagagaguuuuugcuccaucagccaggccuuugggcaucuaacgcccugccuggagcauucugaagguggcagaggccccuggucucagggccc

SEQ ID NO: 4196903 - RNA, 89 nt, Human
gggcccagcucaugaccuuuguuaucuucagaugaugcuagcauuggcugcaaggagaaggauagagaacaaagaucauagcugugcuu

SEQ ID NO: 4196904 - RNA, 68 nt, Human
gggcccaggggcacugccgggcauggccacccugcgccguuugcugggcagugugcccucgagggccc

SEQ ID NO: 4196905 - RNA, 62 nt, Human
gggcccaguggggguugugucucugggcagagagcuuccccaguggcuguccccaugggccc

SEQ ID NO: 4196906 - RNA, 85 nt, Human
gggcccauggcuccuagcuuagggaagggagcacugggauucccucaguccacagucucacuucuugagcuaugcuguaggguuc

SEQ ID NO: 4196907 - RNA, 58 nt, Human
gggccccacuggggcugccugcacccagagacgaugccggcgggaucucagagggccu

SEQ ID NO: 4196908 - RNA, 62 nt, Human
gggccccaugguuauauguacacacugugauccugugagucugcauguguggcuuggggucc

SEQ ID NO: 4196909 - RNA, 84 nt, Human
gggccccccugagaaaggcugcaucucgccucagacugggaccccccugaggauggggcugugucuccccucagacuggggcuc

SEQ ID NO: 4196910 - RNA, 90 nt, Human
gggccccuuuugcagacucggugccuggcaugcgccggugcugccugcugggucuuggcaccacuggcgcagccacggcggcgggggccu

SEQ ID NO: 4196911 - RNA, 85 nt, Human
gggcccgcacuguccagccggagucgguuagagacccucaggaggcucacaggcuccagggccuggauguuaggaugugaggccu

SEQ ID NO: 4196912 - RNA, 60 nt, Human
gggcccggcgcaagggguggcugggaaggggcgcucaguguccaccccuuugcugggccc

SEQ ID NO: 4196913 - RNA, 58 nt, Human
gggcccggggaugcuacacuccgccguucccgucgacccugugguuucccggcggccu

SEQ ID NO: 4196914 - RNA, 78 nt, Human
gggcccuacgggugcgcgcuucgguccuggaggccuuauccaagccuccucuccaucagcgccacccgucuggggucc

SEQ ID NO: 4196915 - RNA, 75 nt, Human
gggcccucuguuagggagcuccacugccucucauucugugcgcagaaagaccgugguuguggagcuagagggucc

SEQ ID NO: 4196916 - RNA, 75 nt, Human
gggagacugcggcuggagcuuugaaccugaucucucaaccucgacaggacaacucagcagccagcagcggcuuuc

SEQ ID NO: 4196917 - RNA, 62 nt, Human
gggagagaauaaugaacgugagacaaucauuacaucaccuuuuccuguacauuauucucccc

SEQ ID NO: 4196918 - RNA, 76 nt, Human
gggagagccagggggccaggagugucccacucauuuuccaggagaugcaaaaucacccugucuccguggguuuccu

SEQ ID NO: 4196919 - RNA, 91 nt, Human
gggagagugaccauggccaaggacaccgcuaggggccucacaagccaaagaugugagucuccuacuggcuguccuuaccccaucacucccc

SEQ ID NO: 4196920 - RNA, 73 nt, Human
gggagaugauauugaggauugaggaaagcacaccgccaggaaggguguucccucugccaucaaauucucaccc

SEQ ID NO: 4196921 - RNA, 117 nt, Human
gggagaugaugggaguuuugaugaggccaugagguaggguccuuaugacaggauuagugucuuuagaagaagagacaucagagggcucacaugaucucucuuucucccucuucucuc

SEQ ID NO: 4196922 - RNA, 77 nt, Human
gggagaugccagcaguagcaguaggccauggaaccagcaugcaaggagugggcugcuucuauugguggucuacuuuu

SEQ ID NO: 4196923 - RNA, 62 nt, Human
gggagauguggggacaaaaugauggccaugugccugugccguccucucuccccaccucuccc

SEQ ID NO: 4196924 - RNA, 76 nt, Human
gggagauugagcaggaacuagaagauagcagaaccagcauucaaaguggacuucagaguucaugcuugugacuccu

SEQ ID NO: 4196925 - RNA, 82 nt, Human
gggagauuuccugaagucaaagaucuaaacccaaaaucuaaaaacauaugaguaaagaguuuugcacuuagggggauuacuc

SEQ ID NO: 4196926 - RNA, 81 nt, Human
gggagauuuucugugugcugucuuggcuuucuuuguuuccuaggcuauagguaagaguuaagacguacaugagugucuucu

SEQ ID NO: 4196927 - RNA, 55 nt, Human
gggagcaaggugagaaaugggaaaggaccagcuugaacacauuuaccuggcuccc

SEQ ID NO: 4196928 - RNA, 106 nt, Human
gggagcaaguucauaccuaccugccuaucagcugccugcuucuuaucauggagaugucagggaggacacuugauauggaucagaccacugguuuggaugucaaccc

SEQ ID NO: 4196929 - RNA, 88 nt, Human
gggagcaccauugucgcguguccagaugaggagacgauguguugcacacagcauugucugccauaucaggaacgugcuggcugcuguc

SEQ ID NO: 4196930 - RNA, 65 nt, Human
gggagcagagacaguacaacuggcaaugugagaguuaccuucccgccagugcugucugugugauc

SEQ ID NO: 4196931 - RNA, 67 nt, Human
gggagcagcagguggcugugauggccuugccccuccugucccugaaggcccugccugccacgcuccu

SEQ ID NO: 4196932 - RNA, 75 nt, Human
gggagcaggaugggagugggguggaaagucccuuauuagccuggaggcugggaugcccugacccucuggaauccc

SEQ ID NO: 4196933 - RNA, 76 nt, Human
gggagcccgggguaggcccugaggcagcucugcuccccccucagggaggccucagccugcccugaacacuggcccc

SEQ ID NO: 4196934 - RNA, 57 nt, Human
gggcgagggcgaaagcgagagccaggaaagcccgggcucucgcuguaagccccgcgc

SEQ ID NO: 4196935 - RNA, 57 nt, Human
gggcgaugcggagcgcuggccaaggcggcgagaguuggcgcaggcuucgggucgcuc

SEQ ID NO: 4196936 - RNA, 55 nt, Human
gggcgccgguccauggggccagccgaacuaccugcuuaguccuaacuggcaguuc

SEQ ID NO: 4196937 - RNA, 77 nt, Human
gggcgcgcaggacggccggucccgggacucucuguccagcaccucgggguccuggcugccgucguccugcggggccu

SEQ ID NO: 4196938 - RNA, 67 nt, Human
gggcgcuggagagacauugcaggagacgaguuucccuuccugcuucugguguguucucucuaggcuc

SEQ ID NO: 4196939 - RNA, 87 nt, Human
gggcgcuguuucuggguccugcauugggagugguaccggauacucaccaggagccaucaggaguccagagacaucacaguucugccc

SEQ ID NO: 4196940 - RNA, 79 nt, Human
gggcggauagcuaauucugagagucagggauagugguaaggaggacauaacaauuuggcuaagauuuaaauguuugccc

SEQ ID NO: 4196941 - RNA, 62 nt, Human
gggcgggacugcggcgaaggggaccccggcccgaccccaggcgccacccuccgcggcugccc

SEQ ID NO: 4196942 - RNA, 72 nt, Human
gggcgggcaguggguggcugcagccuguccuuacauggggcuaaaggggcccagccacuuagugacucaccc

SEQ ID NO: 4196943 - RNA, 91 nt, Human
gggcgggcggaggacgugcacgcacgcuggguggaggcgcaggggucacagguucuggcagcacugcagcuuguugggcuucuguccgucc

SEQ ID NO: 4196944 - RNA, 90 nt, Human
gggcgggcggcuacuuaaggucggcgacccgaggccgcggcugccgacuggguccccugccgcugucgccaccauggcuccgcaccgccc

SEQ ID NO: 4196945 - RNA, 118 nt, Human
gggcggggcggggcggggcugggguccuggcccuggaauagggcagguguucucugaggagcugcuucuguuccuguccuaagggccaauggccucagcaccucuccgauucccuccc

SEQ ID NO: 4196946 - RNA, 62 nt, Human
gggcgugccauuugacagagcaggagccucgaucuggcucugcucccucaaaugacaugcuc

SEQ ID NO: 4196947 - RNA, 66 nt, Human
gggcuaaaggcagucaguuguuuugaaauacaauaguacuuucaggucuagaccugccauaagucc

SEQ ID NO: 4196948 - RNA, 70 nt, Human
gggcuaagaagucaggggacagagguuccaggcccaauaccuucucuguccaccuuggcugacuuaacuc

SEQ ID NO: 4196949 - RNA, 97 nt, Human
gggcuaaggcugaaaucuaagaggaugguuggaaauaagggauauauuuuuaaauaucagggucauuuuagaccagcuucuauagaaacuagagccc

SEQ ID NO: 4196950 - RNA, 57 nt, Human
gggcuacagagaugcaucuucagcaacuggaauagaugaaagugucucuuaaagccc

SEQ ID NO: 4196951 - RNA, 79 nt, Human
gggcuacagguauagguuuggcucucuccaggugguauuugaggcccugggagugacugaaucuauaagagugagaccc

SEQ ID NO: 4196952 - RNA, 67 nt, Human
gggcuacugcacagucauuuccucucaaugcacuauuuacauugucaggaacuaugauuaugccccc

SEQ ID NO: 4196953 - RNA, 95 nt, Human
gggcuagugucuccuuacugaagggccaggggcaggcuggaaggcaggguccccaguccaguggcaccuuggcccucagcaguaagcaccaguuu

SEQ ID NO: 4196954 - RNA, 58 nt, Human
gggcuauaguuuuagcaguggcuguauuuuucugcagccacagcuggucucugagccc

SEQ ID NO: 4196955 - RNA, 66 nt, Human
gggcucaccaggcagcacuuuccuugcagggcucccuguggauugccauggcugcuaggagagcuu

SEQ ID NO: 4196956 - RNA, 66 nt, Human
gggcucagagcauuuggguuggagugugcugcuccagccuucauuuaagguguagugauuaugccc

SEQ ID NO: 4196957 - RNA, 58 nt, Human
gggcucaggccuggccucucacuguccuuaugcagagggggggucccagcuugagccc

SEQ ID NO: 4196958 - RNA, 61 nt, Human
gggcucagggaugccugagaguaggcuuuggccauucugagcaccuuauauucuugagccc

SEQ ID NO: 4196959 - RNA, 72 nt, Human
gggcucaggugauccuaccaccuuggcuuccccaaaugcugaaauuacagcguaagucacagcgccuggccc

SEQ ID NO: 4196960 - RNA, 65 nt, Human
gggcucaugcuuugggucagaaaugccagggggccaccacuguguguuugcccacagcagacccc

SEQ ID NO: 4196961 - RNA, 58 nt, Human
gggcucauguguagccucauuguccucuuguaaaggggggauaggcagccaugagccc

SEQ ID NO: 4196962 - RNA, 64 nt, Human
gggcuccagccacuggcugaggcaucaguaaguugguucuuccccucgccggugcugcaggccc

SEQ ID NO: 4196963 - RNA, 55 nt, Human
gggcuccagggcccgagucgucccgcccggguacgcccucgcauccugagagccc

SEQ ID NO: 4196964 - RNA, 56 nt, Human
gggcuccaguuuggccaggaagagauuuucuuuucuuaucugugggccaggagccc

SEQ ID NO: 4196965 - RNA, 62 nt, Human
gggcucccagccugguggacagaaggacaaggaagccgacuugugccagggauggggagccc

SEQ ID NO: 4196966 - RNA, 114 nt, Human
gggcucccccaagggauccucgggauugaguuauuucuguuuuugcucaccugugccuggcccuggggacagagacaggaaucagcugcagucccugccucccuggaggagcuc

SEQ ID NO: 4196967 - RNA, 109 nt, Human
gggcucccccagauaacccuguaggucuggacccuccuggagugggcucaggggccuggguuuccacuccacaggauggguccagcugccccggcauuuguggcagccc

SEQ ID NO: 4196968 - RNA, 79 nt, Human
gggcucccuaaggaccugcucucccaguucucuacucuucccucugaggcagaggcugggcaggacccacaggcagccc

SEQ ID NO: 4196969 - RNA, 67 nt, Human
gggcucgcaugcagagaauaccugugauccagugccagcuuucaucaccgcuuugcauagccagcuu

SEQ ID NO: 4196970 - RNA, 72 nt, Human
gggcucgcuuagauuuuccucugacgcaacaauuuacagaauccacuguugauuuagggaucuggggagccu

SEQ ID NO: 4196971 - RNA, 75 nt, Human
gggcucgggcucuggugcugggaggaccucgcuggcaggcucgugcagggcccuccuaacaucucugcccagccc

SEQ ID NO: 4196972 - RNA, 96 nt, Human
gggcucuccagcacaccuggauguggaggugugaugcagagugguggcugcucgugacacucauuucaccccuuucugugcaggugccagaagccc

SEQ ID NO: 4196973 - RNA, 94 nt, Human
gggcucuggaugaguaagagccaaggccucagucucaaccguaaaaugacaagcugguucuggggcuaaauggcacugccuaaauccagggcuc

SEQ ID NO: 4196974 - RNA, 62 nt, Human
gggcucuguguucuagcucucgacucgugcagugggagaagagucuuaauauacagcggccc

SEQ ID NO: 4196975 - RNA, 56 nt, Human
gggcucuguuuagaccagagaucagcaaacuaugguccgugggccaaauacagccc

SEQ ID NO: 4196976 - RNA, 56 nt, Human
gggcucuguuuagaucagagaucagcaaacuaugguccgugggccaaauacagccc

SEQ ID NO: 4196977 - RNA, 60 nt, Human
gggcucuuuucacaguccaaaaugauuuggcuuaaacguuuccaacugugaugagguccc

SEQ ID NO: 4196978 - RNA, 76 nt, Human
gggcugaauauauuuuuaugggagaaauaaaauggauaguuuuaaacuugaauuuaguuuuuccuaauggaggccc

SEQ ID NO: 4196979 - RNA, 55 nt, Human
gggcugaccaaugccuugcuuuggaaaacagaauauggaggaagugagucaguuc

SEQ ID NO: 4196980 - RNA, 62 nt, Human
gggcugagaaguugaucccaagguucucuggcuuggcucuugguuugaaguucuucuagucc

SEQ ID NO: 4196981 - RNA, 73 nt, Human
gggcugagcaugugcuagggucugagacagguuaaauagguaaucugcuguuucaaaacuaguacaacagccc

SEQ ID NO: 4196982 - RNA, 62 nt, Human
gggcugagccacagcuuuuguucugauggcgaccaggcguagagggccggggcuccgggccc

SEQ ID NO: 4196983 - RNA, 81 nt, Human
gggcugagcugucuucaaagcucucaguccauauccugaguuauuugauucaggcaggcucagaggaaaacagaaaagccu

SEQ ID NO: 4196984 - RNA, 72 nt, Human
gggcugagggaggcugaacugaguuggagaccguacaccuuguccugaagggagcagccucuacucagcucc

SEQ ID NO: 4196985 - RNA, 95 nt, Human
gggcugauauuuacacaguuaccagcagguggcaguauguauaugaaagugugucguaaauaaugcaacuugcagguuacuggcuauuacuaacc

SEQ ID NO: 4196986 - RNA, 63 nt, Human
gggcugaugugacagaacucuccccauuaacaugcuguuggguagcaguccuucacuuagccc

SEQ ID NO: 4196987 - RNA, 73 nt, Human
gggcugauuguguuccugggagcuggaagcuguuacugcaggguuaaaucagcaacaggagagcaucacuccc

SEQ ID NO: 4196988 - RNA, 63 nt, Human
gggcugcacguauucugcucacagcucacauuccaaugaagugugacuagggagugugggucc

SEQ ID NO: 4196989 - RNA, 58 nt, Human
gggcugcacuagggcaaggugaccacccuacuugguaaagaccugauuggcgcagccc

SEQ ID NO: 4196990 - RNA, 63 nt, Human
gggcugcagcccggcgcgccugagccugcgaguccgcgagccagcgagcugcggcugcggccu

SEQ ID NO: 4196991 - RNA, 84 nt, Human
gggcugcagugaggauucuuaggugguuugaacuuccaccaggcacaaagguggaagcauuugagcuuucuuacuggcaugucc

SEQ ID NO: 4196992 - RNA, 59 nt, Human
ggcucugaguuuagaaggguggggagaaaucuauaucccucagucucuuggucagagcu

SEQ ID NO: 4196993 - RNA, 83 nt, Human
ggcucugcagcucauccucuucuccuggcuccugaggaugccugaaggcagccuggaguucccaggagaagacugaaaaggcc

SEQ ID NO: 4196994 - RNA, 56 nt, Human
ggcucugcccgcggcugcccacgaguucccaccgcccgcccguccgugggagagcc

SEQ ID NO: 4196995 - RNA, 97 nt, Human
ggcucugcugcagugacaauuccaaaucucacugucuucacacagcucauacuguagguccaggagauuuggcaauucgggcugccucugcaguucc

SEQ ID NO: 4196996 - RNA, 86 nt, Human
ggcucugcuuucauaacaagaccuggagaccugagugguauaaacaacuaaaauuuauuucaccaucccaguaugggugcacugcc

SEQ ID NO: 4196997 - RNA, 105 nt, Human
ggcucuggagcuuggaguagcugcauggagauggcagaagcucaaagccacuuccuccaggaagccuucugugauuccuccagccagcuacuccucucccaaguc

SEQ ID NO: 4196998 - RNA, 57 nt, Human
ggcucugggccagaguuggcuucuaggcuauaguuugccaauuccugguuuagaguu

SEQ ID NO: 4196999 - RNA, 66 nt, Human
ggcucugggcugcgggcgccccuccacccccuggcagcuucuggagggggccagcggccuguagcc

SEQ ID NO: 4197000 - RNA, 68 nt, Human
ggcucuggggcagauggaacagagcacacugagaggaugagccuggauuguauuuguuuccccaggcc

SEQ ID NO: 4197001 - RNA, 72 nt, Human
ggcucugguucccggaucuccaugucccgcuccaccagcuaccugagcagcauggguuccgggggccuggcc

SEQ ID NO: 4197002 - RNA, 55 nt, Human
ggcucugucuuugcagucuccaacugcugcucagaggggcuggagggauagagcc

SEQ ID NO: 4197003 - RNA, 55 nt, Human
ggcucugugcagggugcuuuugugaacauggccucauggcaucugcacagcagcc

SEQ ID NO: 4197004 - RNA, 129 nt, Human
ggcucugugcuggcaggcucugcguugcucagauccuguucccaccuacaaccuggagggagggcucccagccccaucuauagagguggaaacugagguucagagagaguguaugacuugccuagggcc

SEQ ID NO: 4197005 - RNA, 55 nt, Human
ggcucuguggcuggccaugauggucgauuggagaucaucugagcccacagaaguc

SEQ ID NO: 4197006 - RNA, 66 nt, Human
ggcucuucaucaucagcaagccauggggcauaugccacaggaagugccuggugagaggauccugcc

SEQ ID NO: 4197007 - RNA, 105 nt, Human
ggcucuucauugcgccagaagugacaaugcugugcuccucaugaggcuccaguggaagcugaauccucacagaggggcagccaucugggacucuggguggaggcc

SEQ ID NO: 4197008 - RNA, 56 nt, Human
ggcucuucuacuucagauggggagcacccgcuucccacuaggcagacagaaaagcc

SEQ ID NO: 4197009 - RNA, 66 nt, Human
ggcucuucuguuucacaggccaaggggcucacagcccagggccuuugcaaagaagcagggcaggcc

SEQ ID NO: 4197010 - RNA, 89 nt, Human
ggcucuucuuagauccaggaaauucccagaaggacugucagcugucagcagcaagcagcuggggaguucuuuaguccuuaaggaggauc

SEQ ID NO: 4197011 - RNA, 97 nt, Human
ggcucuugagacuauggaggcugagaagucucaugaucuacaaucuaccuucggcaaguuggagacucaugagaaccagcaguauaguucagaggcc

SEQ ID NO: 4197012 - RNA, 83 nt, Human
ggcucuuggaagagcuggggcagcuuaggagugacuuugguuaggcauggccagcccccaguuccucugcaauuccaaguguc

SEQ ID NO: 4197013 - RNA, 87 nt, Human
ggcucuuguaaccaugucuuguuuuccuaguuguuuagaacccaaacacuagaagccagaaaaccuucagagaauggacucagagcc

SEQ ID NO: 4197014 - RNA, 57 nt, Human
ggcucuuuucccauuuugcuuaugcugcugucuugaccagucuaggcaaugggggcu

SEQ ID NO: 4197015 - RNA, 72 nt, Human
ggcugaaagaaggauauuugacacauuuacauagcaaacuuagucaauguuuggaaauccuuuguaguggcc

SEQ ID NO: 4197016 - RNA, 61 nt, Human
ggcugaaagaaugggggcccugggccuucuuggugggcuguuguucccuguucucucugcc

SEQ ID NO: 4197017 - RNA, 83 nt, Human
ggcugaaaggauaaaugcauacaugguuuugauggauauuucugaauuuuccuucacuguaucauguugcacuuaacacugcc

SEQ ID NO: 4197018 - RNA, 57 nt, Human
ggcugaagagaggccuugagcaccuuaggagugcuuggaccaggucaucuucaagcu

SEQ ID NO: 4197019 - RNA, 130 nt, Human
ggcugaaggauggcaauuaacaaugaaacauagaaagcagaugaaauugcaacaaauuguaaagaaaaaguguagcaaauuaucgugccuuaaaugugcuguucaacuaaucacugccaccagaaauacc

SEQ ID NO: 4197020 - RNA, 61 nt, Human
ggcugaaggcagugaguuuguguuuccuuuggaaugagcacauguucuacuggcuucugcc

SEQ ID NO: 4197021 - RNA, 64 nt, Human
ggcugacacuuuagcuuugaagucauuaaccacuaggugguaguuaaagcuaugguagugggcu

SEQ ID NO: 4197022 - RNA, 74 nt, Human
ggcugacagaccgguaugcagggacguuccuccauggccucccaugacaggcucugcagugcuggaggacagcc

SEQ ID NO: 4197023 - RNA, 85 nt, Human
ggcugacuggggcacaggcucccgaaaucacccaugugguugaccucacuuggagaagaggggucuggccuaaugucacacagcu

SEQ ID NO: 4197024 - RNA, 66 nt, Human
ggggguggagacuggguccaggaccuagcagcccuaccucgaggcccugcuuccaggcucaccccc

SEQ ID NO: 4197025 - RNA, 74 nt, Human
ggggguggccagaggcagaugcccaaugcuggcagaaggugugcagagcauugagggucugccaaguuacccuu

SEQ ID NO: 4197026 - RNA, 95 nt, Human
ggggguggggucccaccaggugaccauuucaugugagguaaauggagucagucagaugaagucacuugucaccugccucugugaagccucccccu

SEQ ID NO: 4197027 - RNA, 57 nt, Human
gggggugguucuaaguccuauauggucacugcaugaggcuaagaugacuccaccccc

SEQ ID NO: 4197028 - RNA, 91 nt, Human
ggggguguggaggagagagagugagcuuugcuaaacccaggcccaauugcaugaaguugcuguagcucauuucacucuccuuuguuccuuc

SEQ ID NO: 4197029 - RNA, 81 nt, Human
ggggguucuuuggaauaagucaagcuguuggaagcuuugucugggcaaaguguguagcugacaucuaaaggaacuauuccc

SEQ ID NO: 4197030 - RNA, 89 nt, Human
ggggguugaauuuccugggccuuugcuuauuaauuuuauuuuaaaauacggaauuauaggcaaagcagucauuuaaaaugcaaaucccc

SEQ ID NO: 4197031 - RNA, 61 nt, Human
gggguacagaauaaaaauccuacaggauaaaauuccagccuguuuauuuccucuguaccuu

SEQ ID NO: 4197032 - RNA, 64 nt, Human
gggguacccaaagcucuuggauuuuagacucagaaggccuggguuaaaaccugaacucuacccc

SEQ ID NO: 4197033 - RNA, 94 nt, Human
gggguagacuccucucggggagaaggugucccaggccagcugugugugcuggggccgaccacacagcugcugagacaggcccuggaggaacccc

SEQ ID NO: 4197034 - RNA, 59 nt, Human
gggguagaguuuggcuuucaaaugaccagcaagucaacauuggcagcagcucagccacc

SEQ ID NO: 4197035 - RNA, 71 nt, Human
gggguagaucuagaauguaaauccagacacagcucaaaauugaugucucucuauacucuaacucuuucccc

SEQ ID NO: 4197036 - RNA, 68 nt, Human
gggguagcagcugcccugccuugcccuuagagcaucuccuuaaaagcacaacagguaggccagacccu

SEQ ID NO: 4197037 - RNA, 58 nt, Human
gggguaggaagagaaaauagugcuugucuccagaauuacuuuuuucacuucuagcccc

SEQ ID NO: 4197038 - RNA, 72 nt, Human
gggguaggaugccuugucccaucuguggccucagcccacuggguuccagacacaccaggcccauucugcuuc

SEQ ID NO: 4197039 - RNA, 57 nt, Human
gggguaggcaggugaucugaucagggcgaagacccagaccagcacguagguugcccc

SEQ ID NO: 4197040 - RNA, 63 nt, Human
gggguagguguagcgcuauaaccaguuuaugggaacaccaggaaauagcuugucagcugcucc

SEQ ID NO: 4197041 - RNA, 128 nt, Human
gggguauuguggccagacuccaaaagacuuguccacggcugagcuaauccggccugggcccagaggggagcagagccugccucuggcuguggacagggcgucuggaggggccucacucuguguacccc

SEQ ID NO: 4197042 - RNA, 76 nt, Human
gggguauuucugcugaggcugagcaaugagccaccagaagcaauggcucauugcucaggcccagcaggaauucccc

SEQ ID NO: 4197043 - RNA, 64 nt, Human
ggggucaaggcagcagggccugugggccccgauaaggcuccacagaggacaacugccuggcccc

SEQ ID NO: 4197044 - RNA, 83 nt, Human
ggggucaucugaccuggcuuuggggauaggcuuccuguaaggaagggcaggaguuagccagacaaagugggucagaaggcccc

SEQ ID NO: 4197045 - RNA, 87 nt, Human
gggguccauuucauuuacauuuccuguugccaucaagaauggcucuuuaaugaguuuuccgcagcaggauguagagacacagaugcc

SEQ ID NO: 4197046 - RNA, 86 nt, Human
ggggucuaaagccaggcagggcucucgcucucugggucccuuucagcacagagcagcgagccagcucugcggguccucccuacccc

SEQ ID NO: 4197047 - RNA, 86 nt, Human
ggggucuagcccaugggagguguucugccaacgcgggucccucccguccccuucaggagccgcggugcgcugaccacuucgacccc

SEQ ID NO: 4197048 - RNA, 88 nt, Human
ggggucucacucugucacccaggcuggagugcaguggcgugaucuuggcucacugcaaucuccgucucccagguucaagugauucucc

SEQ ID NO: 4197049 - RNA, 56 nt, Human
ggggucucagagcucggggugccaucuucugggggacccacggucuuugaggcucu

SEQ ID NO: 4197050 - RNA, 58 nt, Human
ggggucugcugcggagcagagagacugauuauuauuuuuuaaaucuccaguugacccc

SEQ ID NO: 4197051 - RNA, 55 nt, Human
ggggucuggggugugugguucugcccaggucugcagacagcagucuccaaacccc

SEQ ID NO: 4197052 - RNA, 89 nt, Human
ggggugaaaagaaauguugccuaacuggccuuuacucacggagugaccaucaucucagcuaguuaguguaugagcggcaccagcacccc

SEQ ID NO: 4197053 - RNA, 60 nt, Human
ggggugaagcuaaacccacagugaacgugaagcaaucugugguuaaaguugugucauccc

SEQ ID NO: 4197054 - RNA, 80 nt, Human
ggggugaauuaaauggaucuguggaauacauugugacacuugcaucacaagugacccugagccauuuccacuuucacucu

SEQ ID NO: 4197055 - RNA, 69 nt, Human
ggggugacaggccugagguuccugugcucaccagcagcgaaggugacauuagaacccaggugucucucc

SEQ ID NO: 4197056 - RNA, 60 nt, Human
ggggugaggaaagauggugacagugaugaaauaaauaccaugacuguucucuccugcccu

SEQ ID NO: 4197057 - RNA, 59 nt, Human
ggggugagggaugagccuucuucggcaucgucagaaaaggcucucacucccuccguucc

SEQ ID NO: 4197058 - RNA, 61 nt, Human
ggggugagucaugauuguucugagucagaauaagucuaagucaagcauggugccucaccuc

SEQ ID NO: 4197059 - RNA, 68 nt, Human
ggggugaguugaguuaguggauuuguuuccucuuaagaggcugccgaaacugaucuuguucuuacucc

SEQ ID NO: 4197060 - RNA, 94 nt, Human
ggggugaucaagguaaccagaacuggugcauacucagucuucacggagacugcuucuccaaugaauuagauucuguguucuugccuugcacccu

SEQ ID NO: 4197061 - RNA, 79 nt, Human
ggggugcagccaagccucccacgagcucaccagcaucucggguugaggagcaggaugggaggcugggcuccgccauccc

SEQ ID NO: 4197062 - RNA, 116 nt, Human
gggguggacggcgcggggggaggggcgccuggcuggaacgccgaggcggcggcucggccaaucagcgcgcggccgccggcgguuucaaggugccccgcgccgcgcgcccccacccc

SEQ ID NO: 4197063 - RNA, 88 nt, Human
gggguggagaguucuguagauaucuauuaggucugcuuggugcagagcugaguucaauucuuggauauccuuguuaacuuucugucuc

SEQ ID NO: 4197064 - RNA, 90 nt, Human
gggguggaggagguauuccugcuucagguagaggggguggaagggguauucccacuccggguacagggggcagagaggguauuccagcuc

SEQ ID NO: 4197065 - RNA, 76 nt, Human
gggguggcccuacccucuggaauauacaaaaccuuacacagacacaauauauacaccggggaaggggggccacccc

SEQ ID NO: 4197066 - RNA, 109 nt, Human
gggucaggaaacuuggaaugggggaaucuguuuagacucaguugaaacugaccaucuggaaacagaaagucaggcugagccuuucuuaccaguuuaaguagcuugucuc

SEQ ID NO: 4197067 - RNA, 73 nt, Human
gggucaggaggcugaauggccagaagccagcaaccugcugguggucaccauuuucagacccaagugccugccc

SEQ ID NO: 4197068 - RNA, 71 nt, Human
gggucaggcucagcagggcagcccugucaguucuucaaaagcagggaccucagcccuccugggcuuugccc

SEQ ID NO: 4197069 - RNA, 67 nt, Human
gggucaggcugcccguucagggcucggcgugugaggcggagacucuccuggggagccugcggugccc

SEQ ID NO: 4197070 - RNA, 77 nt, Human
gggucagguguuuuauuggcagcaugagcuccugggauguucauucaccucauuuucauugccagucacgcugaccc

SEQ ID NO: 4197071 - RNA, 62 nt, Human
gggucaucauacugaacuguaucagggaaugccauucagaucauagucuuugugacuggccc

SEQ ID NO: 4197072 - RNA, 60 nt, Human
gggucauccagcaccucugggucuugucuuucaauaaaggaauggcuagaagugugaccc

SEQ ID NO: 4197073 - RNA, 63 nt, Human
gggucaugcugcuguguuggagagggacuggaaaaacacucguguuccuacacuguaggaucc

SEQ ID NO: 4197074 - RNA, 78 nt, Human
ggguccaaaggagccaagauggggcaaguaugggagggcccagcccugugccagcucccuuuucuccuccccugaccc

SEQ ID NO: 4197075 - RNA, 76 nt, Human
ggguccaauuuuauucuucugcaaguggcuauccaguuuucccaacaccauuuguugaaguaguugucuuuccccc

SEQ ID NO: 4197076 - RNA, 69 nt, Human
ggguccagaguugaagagguuagaaaguuggcagaaacaacucuaguaauaaggcuugaacuuugaucc

SEQ ID NO: 4197077 - RNA, 81 nt, Human
ggguccaggcaucuguauuuuuuaaguucccccagauaaugcuaauagacaucuaggauugaggacugcuauccuggaccc

SEQ ID NO: 4197078 - RNA, 82 nt, Human
ggguccauuuguguuccuguuucugcguaguuuguagcucauauucagugcagaaauggggagcucagcagaaagcaagccc

SEQ ID NO: 4197079 - RNA, 62 nt, Human
gggccugccauugcugccccagcccugggcucagggagcaggugcauagcagaggcagggcc

SEQ ID NO: 4197080 - RNA, 55 nt, Human
gggccugcccacgugggguuaagguuaccaguggccucugccucuggucaggcuc

SEQ ID NO: 4197081 - RNA, 85 nt, Human
gggccugccucuugguuuucugcaccucagcuuuucccggauagguggggacccaucaucaaaagugacagagaagauaaggccc

SEQ ID NO: 4197082 - RNA, 60 nt, Human
gggccugcuggugcuuccauugagacacccauucucgcaauaggaaagaccagcuggccu

SEQ ID NO: 4197083 - RNA, 60 nt, Human
gggccuggcagggcugcaguaauggggaaucacacuucauuauugcuguuuucuaagucc

SEQ ID NO: 4197084 - RNA, 58 nt, Human
gggccuggcaugcagccccguuccagggagaagaaacggggaugcgaccacaggcucc

SEQ ID NO: 4197085 - RNA, 96 nt, Human
gggccuggcucugagucacggacgggacccagccucccagaaacaacccuguucagcucuggagcgaggucccugucugggaaaagacgccagccc

SEQ ID NO: 4197086 - RNA, 56 nt, Human
gggccugggcacccuauccccaggacacaggaccugggcacccaguaccuaggccc

SEQ ID NO: 4197087 - RNA, 106 nt, Human
gggccuuacaauaucauagagguuugugagcauguuuacuugauugauauauguucagaacaggucuuacagccacuuuuugcuuuugugaugauuuguuuugccu

SEQ ID NO: 4197088 - RNA, 72 nt, Human
gggccuucagugacagccacccaggcaccaugcauaacugcaccaggucugcuaagcugucauucugagccu

SEQ ID NO: 4197089 - RNA, 62 nt, Human
gggccuuccagugauaugcgugaaucagcauuagauccgcuuaucucagcuggcaggagccu

SEQ ID NO: 4197090 - RNA, 60 nt, Human
gggccuuccucccucaggcuccucucaccccucggggcugcccucaggggaggauggccu

SEQ ID NO: 4197091 - RNA, 76 nt, Human
gggccuuccugaguucuguagggugaaauagucauucuuggccuaucuaucacugcagaccuugggguuguggccu

SEQ ID NO: 4197092 - RNA, 66 nt, Human
gggccuucuguccaggcuggccuggaucauucuccagguacaucuauggggauagaacaguggccc

SEQ ID NO: 4197093 - RNA, 84 nt, Human
gggccuuuggccuccugaaguuuaugcuuuucgggucuuaaaggaugcuggaccccgagaguuggacuccagagcuaaaggcuu

SEQ ID NO: 4197094 - RNA, 57 nt, Human
gggcgaaugcucuuucugaacauucucagcuuuagcuaagcaaggaaagggcagccc

SEQ ID NO: 4197095 - RNA, 75 nt, Human
gggcgagcuacugauucccuggugccuccguuucuucuuaugaaaagggcguaacgggaguucuuaguucagccu

SEQ ID NO: 4197096 - RNA, 69 nt, Human
gggcgaggcgcaggagaggggagcccagguuuggauuugucaaacuugagucacuucucuucccucccc

SEQ ID NO: 4197097 - RNA, 82 nt, Human
gggcgccauucugagcaugcuacaugcagcaccuuguguguuccccacagugcccuguaaguugugugcucugguugugccc

SEQ ID NO: 4197098 - RNA, 56 nt, Human
gggcgcccccuucaaacagagcacagcccaggagcugcuccaggagggggcagucc

SEQ ID NO: 4197099 - RNA, 123 nt, Human
gggcgcgcgcgcggggggugcgcgugucccgggagcgcguccgcgcggcggccucccgcgugcucgugugcgcgcgcgucccgggugccgcgcgcccuucuuaugcacagcugcggugcgccc

SEQ ID NO: 4197100 - RNA, 124 nt, Human
gggcgcgggcggcggcggggggcgccggcugcugcggcggggccgggcggcugcuccgcgcaugugcacccguccagguggcccugcccuacucugcggcgccggcacggccgcccccgggccc

SEQ ID NO: 4197101 - RNA, 85 nt, Human
gggcgcgguggcucacgccuguaaucccagcacuuugggaggccgaggugaguggaucacgaggucaggaguucgagaccagccu

SEQ ID NO: 4197102 - RNA, 76 nt, Human
gggcgcuguggcugcgguuguccucggcggugcccacuacgccgauggaggagauggacagcugcgcgcagggcuc

SEQ ID NO: 4197103 - RNA, 67 nt, Human
gggcgcuuuguggagaccuccuaggauguguaggacccccacacacccugugagucccuggcugccc

SEQ ID NO: 4197104 - RNA, 77 nt, Human
gggcggagcuaccagcccaggcucagauguuggggugugaaagccucaagugacucagccugguuggagaacugccc

SEQ ID NO: 4197105 - RNA, 78 nt, Human
gggcggauacccugggugacccgugagcguccgcgcccggcgcgcgccugcgcagucgcuuuucgagaguuuccgccc

SEQ ID NO: 4197106 - RNA, 71 nt, Human
gggcggccaggagagcccggguccgggcuuccgccuucgcagggccugucucgggcucuucggccgggccc

SEQ ID NO: 4197107 - RNA, 76 nt, Human
gggcggcccgugcgggauccccgcgcucuccaccugcgaggggcgggccggagcugggucccgcgcgcgguuuccc

SEQ ID NO: 4197108 - RNA, 69 nt, Human
gggcggcugaggcuggcguuugaggaagcccggaaaugggccucuuucaccgugccugucccgcuggcc

SEQ ID NO: 4197109 - RNA, 93 nt, Human
gggcgggcagucccuaggggcaucccucugaggggccaggcuccaucuucuaggaugccugguguccagaggcgaguggaccgcugccuaccc

SEQ ID NO: 4197110 - RNA, 68 nt, Human
gggcgggguggcucaugccuguaaucccaguacuuugggaggcugaaaugggcagaucacuugagccc

SEQ ID NO: 4197111 - RNA, 72 nt, Human
gggcgggguuuggggagguucgggaaucuuguggcaucugcccucaacacagguuccaucuccaccuugccc

SEQ ID NO: 4197112 - RNA, 95 nt, Human
gggcgguaauuagcuaaugcuucuggaaugcugcuuccuucccaccagccccuggaggucagcaggccaggggcgaaggcagcuuuguccugccc

SEQ ID NO: 4197113 - RNA, 108 nt, Human
gggcguggggacaagguuugcaugggagaccaggcaauuccaguuaguggguucccgucuagcccaggaaugccguggccucuggucagcuccuucugucuccggccu

SEQ ID NO: 4197114 - RNA, 61 nt, Human
gggcgugggguagguagacauggaggggaaaaauaauacucugugcuuaacuacucacccc

SEQ ID NO: 4197115 - RNA, 78 nt, Human
gggcgugugugggagcaggagagggauucucugggguccccauuuggaaccuggagacccacuucugccaacaagucc

SEQ ID NO: 4197116 - RNA, 116 nt, Human
gggcuaaaaucaagguguugucagggcugugugucuuucuggaggcuccaaaggagaaucccuuuucuuacuauuuccuucuuccagaggcugcccagaucccuugguucauaucc

SEQ ID NO: 4197117 - RNA, 72 nt, Human
gggcuaaacagagagcuuccuugauuauguucagauugaaugaaaucaaacccuuuucugauauuguggucc

SEQ ID NO: 4197118 - RNA, 56 nt, Human
gggcuaaaugcagaaaugcagagaaagaccucugaccacacaguucugucuagucc

SEQ ID NO: 4197119 - RNA, 58 nt, Human
gggcuacagacaugcucuaagcuuuacuauugaaaguuaguggagcuuguuguggcuc

SEQ ID NO: 4197120 - RNA, 70 nt, Human
gggcuaccaccuccauccuccuuucagccagcagggacaguuucuggaaggaguggugagguuggagucc

SEQ ID NO: 4197121 - RNA, 88 nt, Human
gggcuaccugagauugcaggugccaccaguugcaaucugggccacaugcaagcuggugucaccuccaguccaccagugaauuuagccc

SEQ ID NO: 4197122 - RNA, 76 nt, Human
gggcuaccuggcuccugugguacucccagggccugggccaggcggggaaugcgcacgggaacugcuuuuuggaccc

SEQ ID NO: 4197123 - RNA, 60 nt, Human
gggcuagcagauucuaccuaauugcucuccccacauccagaaguaggugguugcuggucu

SEQ ID NO: 4197124 - RNA, 73 nt, Human
gggcuagcgcuaguguuaugcaugcacuuggcugcaggaacuggcuacagguaugugcaugacaucacagccc

SEQ ID NO: 4197125 - RNA, 77 nt, Human
gggcuagcuuaccuuaggccauaaguauuauuuguugagaugcgugaauacaagaaugucuuaaaagcucuaggcuc

SEQ ID NO: 4197126 - RNA, 62 nt, Human
gggcuaggggaauaaucugugguaguuuuaugagugaccaucauuguuuuuucucuuagucc

SEQ ID NO: 4197127 - RNA, 99 nt, Human
gggcuauaagauauuugaaagaaacccuagcguuguuuauugaauccaggguugacucaagaagauaaugucuaggguuagauguucaaaaauauaccc

SEQ ID NO: 4197128 - RNA, 56 nt, Human
gggcuauggaacagugaggcugggauucgaacccaggcugucugaccccagagccc

SEQ ID NO: 4197129 - RNA, 71 nt, Human
gggcuaugucuucuuguuuugaaggaaauaggacacacacuaucuuuccaaucaccaaggagaaagaggcu

SEQ ID NO: 4197130 - RNA, 90 nt, Human
gggcucaaaauuuaggaggcauuugcucccagggcugacauugcacuuuugggacccucagagcaaaugucuccuuaaauuucccagccu

SEQ ID NO: 4197131 - RNA, 82 nt, Human
gggcucaagggggcucuggagaagaggagcuggaagccugggccucccauguacccaccuccauucucaucugccugggccc

SEQ ID NO: 4197132 - RNA, 58 nt, Human
gggcucacccaacucuggaaaaucaucugaugaagccucagaggcugggggaaugccc

SEQ ID NO: 4197133 - RNA, 62 nt, Human
gggcuccaggacucaggccccugggaaagggcccccacucagcauccaguuccugcgagccc

SEQ ID NO: 4197134 - RNA, 65 nt, Human
gggcuccaggcuuuggggcaggagcgcuugccccugggugcccugcccucgcggccugcaugccu

SEQ ID NO: 4197135 - RNA, 55 nt, Human
gggcuccaguuguccccaggaucccucccccgacccgggggcccccuuggugccu

SEQ ID NO: 4197136 - RNA, 62 nt, Human
gggcuccauacuuccaacaaacuuuagacugaaucauaucuagcagcuugagucuggagcuc

SEQ ID NO: 4197137 - RNA, 108 nt, Human
gggcucccauccggguaccugaggauuuuccacauagaucacagguguuggggcccacaucggcuccugaaagacuaugggaacgccauaggccuggggcgggugcuc

SEQ ID NO: 4197138 - RNA, 73 nt, Human
gggcucccccgcaggugccggcagaugggguagcgaaugguccugugccuccaccugcuccgggagggagucu

SEQ ID NO: 4197139 - RNA, 76 nt, Human
gggcucccucaccaccaucacaugacacaaaccaaaaaagaggucuucaagcaugugcugagugcuggggaagucu

SEQ ID NO: 4197140 - RNA, 85 nt, Human
gggaauguggauucagguggaauuaauuaagagagaacuaacuuccagcucuuuauuaguguguugcaccugcauccuaguggcc

SEQ ID NO: 4197141 - RNA, 56 nt, Human
gggaaugugucugauggaaagaauauucuuuuguucaaauccaucagcaaauuccu

SEQ ID NO: 4197142 - RNA, 56 nt, Human
gggaauuaggcacacaacuucuguuaagaguaaaggaagcuuaaugccuaauuucc

SEQ ID NO: 4197143 - RNA, 87 nt, Human
gggaauuauugaaugauauuuguauuacaaagucacaguaucaauaugucuguguaaugugugauacauagauccuaauuuauuccu

SEQ ID NO: 4197144 - RNA, 125 nt, Human
gggaauucaauccauuuuggcugcuuuaauggagcuccuggggcuuagacacuauugaaaggcaauuacugacuuucaguuguuuuagcucugugaguucauugcuagcccccucccuuauuccc

SEQ ID NO: 4197145 - RNA, 72 nt, Human
gggaauugguguggcagggggaaguuuugaugguaaaacgagcaaagcuuuaucccuugcccaucgaugccc

SEQ ID NO: 4197146 - RNA, 58 nt, Human
gggacaaacugacuccugcuguugacuuaauuucugcacugcuuucacaguuuguucc

SEQ ID NO: 4197147 - RNA, 69 nt, Human
gggacaaggcagugugcaaaggauuuuaaauggauucuuucauuuaauccucacaagccuauaaagccc

SEQ ID NO: 4197148 - RNA, 58 nt, Human
gggacacagagcaaaucaugacagaugugggcccaucuggccauuugaucguaguccc

SEQ ID NO: 4197149 - RNA, 84 nt, Human
gggacagccuuuguccagugcaccagccucagcccacggagaagagugacugaggcccuagggcaugggagaggagggacgccc

SEQ ID NO: 4197150 - RNA, 90 nt, Human
gggacagcucucuuuuuggcccugacacuuugcagcugaguuuguacacuuaaauugaaguugcugugagggcucuagacuagcuaaacc

SEQ ID NO: 4197151 - RNA, 105 nt, Human
gggacaggaauggaugagcauacagggacuugccucaacugacccuuagggcuuccugagcacaggagccagguccuucacaugcauuucucagcuaauucuccc

SEQ ID NO: 4197152 - RNA, 76 nt, Human
gggacaggcagccugcugcucgaccagucccaggccugaggagguccacggggccagcgagggcaaggccuguccc

SEQ ID NO: 4197153 - RNA, 78 nt, Human
gggacaggcaggugaaagugaguagugagaacaaaaugugagcaaacaaccuucauuacuggcaaucugugugauucc

SEQ ID NO: 4197154 - RNA, 96 nt, Human
gggacaggcuccauggaaaaggcuguuguucaacuguuggccuuuucagccccauugugcggacagcaguuuuucucuaggguaccaaaguguccc

SEQ ID NO: 4197155 - RNA, 68 nt, Human
gggacaggugccagggucagcugcagcucuccuuccgggagcagggugugguggcccuggaugguccc

SEQ ID NO: 4197156 - RNA, 77 nt, Human
gggacaguauggaucuaaaucauuuccaucaccaucaaaaauuccacuggacagugcugaucuagacugaccauccc

SEQ ID NO: 4197157 - RNA, 58 nt, Human
gggacaguuucuccauuuacaccuuuugccuucagaagccucugggaaagccuguccc

SEQ ID NO: 4197158 - RNA, 91 nt, Human
gggacauauuagugucugugaauaauucucuccaucuuaaaccaagggaagggggccuaaacaggauuguccacagacagcaauggcucuc

SEQ ID NO: 4197159 - RNA, 64 nt, Human
gggacauggaggcgcgcaggcacugaggacgaaagggcccuggagccuggacgccguccauccu

SEQ ID NO: 4197160 - RNA, 85 nt, Human
gggacauguuugugggcgcuaacagcacuuauuuucuccaaagggcaaauuucaaacaauuccugugcugagugaucccauuccu

SEQ ID NO: 4197161 - RNA, 85 nt, Human
gggaccaggggccagagauaugaagaacuauggcuuugggggugccugccuaacucacaagagcccucuucacugccccuugccc

SEQ ID NO: 4197162 - RNA, 72 nt, Human
gggaccagggguuuaaggaaacgccugucugcaaaagaggguacaagacaggcagaccugugcccugggccc

SEQ ID NO: 4197163 - RNA, 56 nt, Human
gggaccccguaggccaccuguguuccuucagagcagugcuagccucacagggucuc

SEQ ID NO: 4197164 - RNA, 74 nt, Human
gggacccggguuugcgcguguggaaagcaaaagggguuacucugcuggaguucgacauugcaaauaaaggucuu

SEQ ID NO: 4197165 - RNA, 95 nt, Human
gggacccuugcugaagcugccugucuuuccucccucguagagacagggcgcuuuagaggagagguggcggaguuugggaagucaguuagggaccc

SEQ ID NO: 4197166 - RNA, 79 nt, Human
gggaccucacaauugaguuccacaaaccacaugagaauaauuacuguagaauggaaccaauuguaguggcugagcucuc

SEQ ID NO: 4197167 - RNA, 61 nt, Human
gguacccgcucugccucuuugcugcgucacagggugugauaaguuacacagaggagggccc

SEQ ID NO: 4197168 - RNA, 80 nt, Human
gguaccugagaagagguugucugugaugaguucgcuuuuauuaaugacgaauauaacacagauggccuguuuucaguacc

SEQ ID NO: 4197169 - RNA, 125 nt, Human
gguaccugcagugauguauauuuuaaggcuuagauucauuuuagcaaaaguuaguuuucuguaaauugcauucuagcucgcuguaaaaugaauucuaaguucucuuaguguuccacugcuguacu

SEQ ID NO: 4197170 - RNA, 97 nt, Human
gguaccugguagcucaucaaagacuagauaauccaagauugccucacucacguuuuuggugaaugaggcuggcuauggauuaauugguccaggggcc

SEQ ID NO: 4197171 - RNA, 84 nt, Human
gguacguugcaacaagcagcaaguuuauuucuaucaguguuuguacagauuuuuuaaaucuguugcuuuuuucucacauguacc

SEQ ID NO: 4197172 - RNA, 57 nt, Human
gguacuacaugguuggcuggggcauuuaauccugccaaggagacacgguguuguauu

SEQ ID NO: 4197173 - RNA, 70 nt, Human
gguacuaugaggcacguguuacuggccuaguuggagaccacuggagaggucaguuauauugcccaaggcc

SEQ ID NO: 4197174 - RNA, 81 nt, Human
gguacugaucuagaugcucaggaugcaggaauaaaccaaaagagacaaagguuucugcuguccuuuauauagauuacagcc

SEQ ID NO: 4197175 - RNA, 81 nt, Human
gguacuguggcauugaguggagaagaggauggucuccugaauagguuaggggucauuccuccccuccaguccccacaugcc

SEQ ID NO: 4197176 - RNA, 61 nt, Human
gguacuguugcuugcauaaugcuggcaugucccaacaugucccaaaugcaggcaaaguucc

SEQ ID NO: 4197177 - RNA, 74 nt, Human
gguacuucauguaaguggaaucacacaauauuuaucuuuuugugacuggcugauuuuacuuagcaugauguucu

SEQ ID NO: 4197178 - RNA, 64 nt, Human
gguagaagccaguggcuucucccugcugcccucacagcaggugagcacagccaggcuggcugcc

SEQ ID NO: 4197179 - RNA, 61 nt, Human
gguagaaugauuuuggacaauauggaucauaagaugauuuaaugucuuagauguuacuacu

SEQ ID NO: 4197180 - RNA, 84 nt, Human
gguagagaaauugcaaaguaaaaauagauucugagcauauaugaaauuaguuuagucauguuuuuaguuuaacagcuuacuacc

SEQ ID NO: 4197181 - RNA, 66 nt, Human
gguagagaugggcugagggaaaggaaagcuaggaacgaagaguacaccaccccaguccucuuuccc

SEQ ID NO: 4197182 - RNA, 74 nt, Human
gguagaggcggguggaucaugaggucaggagaucgagaccauccuggcuaacaaggugaaaccccgucucuacu

SEQ ID NO: 4197183 - RNA, 59 nt, Human
gguagagggaaauggaggaaagagacauuaaaaggaaaaugucaccauuuccaaaugcc

SEQ ID NO: 4197184 - RNA, 68 nt, Human
gguagauaguuggaauauuugugaauaaguuguugguauuuuacaaaguauauuucuagcugucagcc

SEQ ID NO: 4197185 - RNA, 118 nt, Human
gguagaugguuuagggaaauagcuugcagggaggagggcuuaguggagaaggucuguaggggcccugaguugagccuuccaaaacauuccuacaagccaaacagagagacuaucugcc

SEQ ID NO: 4197186 - RNA, 58 nt, Human
gguagcaaucagaaagaaccuugggauuuggggguccagagagaucuucugauagacc

SEQ ID NO: 4197187 - RNA, 64 nt, Human
gguagcaaugcauauguggguagcauggaauuugaacagcaccugcuuaaugugcagugagacu

SEQ ID NO: 4197188 - RNA, 78 nt, Human
gguagcauguagucagaguaugucaauguucuuuuccuuggaaauacaucacuuaugaaauauucuuuugcaugagcu

SEQ ID NO: 4197189 - RNA, 77 nt, Human
gguagcaugucauuauuuuccauguugguuucaaacagaugauuccacuugugaaauaaucaaauauaauugcugcc

SEQ ID NO: 4197190 - RNA, 82 nt, Human
gguagccacccagcucuuugauggucuuggccugcugguucaggaagucguucuccaggaagucgcagagcugggggucgcc

SEQ ID NO: 4197191 - RNA, 88 nt, Human
gguagcugguacaaaggagaauaggguagcaagcauaguaagcaugcugcuuaauuuuuuguucagcauccuuuuucuagaaacugcc

SEQ ID NO: 4197192 - RNA, 87 nt, Human
gguagcuugcaucacuuuacagugcugcuaauggcucaucauggggagccagauaaaagcauuuaaagaggaaacaaugcaggcucc

SEQ ID NO: 4197193 - RNA, 64 nt, Human
gguaggagagggccauggaaggagagggcaccccugccagccuugcccauggcucccuccugcc

SEQ ID NO: 4197194 - RNA, 73 nt, Human
gguaggaggacaggucugcaguaacugggaacuugggugaguuacccaacugcugagccuugguuuucucgcc

SEQ ID NO: 4197195 - RNA, 71 nt, Human
gguaggaggcucacuuaagcccaggaguuucaagauccuccuggacaacauagugagaccucaucucuacu

SEQ ID NO: 4197196 - RNA, 80 nt, Human
gguaggaguaguauaguaucauaaguuaauuaaacaguagacuuacuaucugguauuuccuuugauagcuaauacuuacc

SEQ ID NO: 4197197 - RNA, 70 nt, Human
gguagggacucuucugggaagcugacauguauccaguaggguaguuuagcaauuccagguaaguuaugcu

SEQ ID NO: 4197198 - RNA, 60 nt, Human
gguagggaugggauuuggaaguaggagcucagaguucaaauucugacccuguccauuacu

SEQ ID NO: 4197199 - RNA, 64 nt, Human
gguagggcucaagaaaguguaccucaguaagaccuguggacuuuuguuucuuggauacucuucc

SEQ ID NO: 4197200 - RNA, 63 nt, Human
gguaggggcaagucuggccauuucucuggaaugucaaccgagaggccaacuucuugccccucc

SEQ ID NO: 4197201 - RNA, 68 nt, Human
gguaggugagaaggacuguugcauuucuguuguucacucaucaaauagcaauuacccuucaacucucc

SEQ ID NO: 4197202 - RNA, 83 nt, Human
gguaguaaaaugggaauaugaaucuagaaaaugaugcuuuaagagccuuaaaugcuagauucauaccauuguauuagggaacc

SEQ ID NO: 4197203 - RNA, 82 nt, Human
gguaguaagugacugaacuaggauuggaaugagagcagucuggcuccauugucuuugguccuagccucuuuucaacacugcc

SEQ ID NO: 4197204 - RNA, 78 nt, Human
gguaguaccagaugagcugagaucauguacacuagugguugcucccuacauuaaauuggcuuacuuaucuaugcugcu

SEQ ID NO: 4197205 - RNA, 62 nt, Human
gguaguucuuaugcacacaucgcagcaggaacagugguguuccacgugugugugcagccgcc

SEQ ID NO: 4197206 - RNA, 71 nt, Human
gguaguuugaguuugcguugggguuuucugucacuuuuugacuggaagaguccuaaacagauauacaugcc

SEQ ID NO: 4197207 - RNA, 104 nt, Human
gguauaaucuguuuuucuuauacuucuagcacaagauaugaaaguguggaagacaucaaauuaugugcuacaagaaugaugauguaaagaaagcagacaaagcc

SEQ ID NO: 4197208 - RNA, 85 nt, Human
gguauaauuucaaguugaacaguauuuuuuaucuuuagcaucauuguaugagaugcagaguuugcuguggacuugggccuauacu

SEQ ID NO: 4197209 - RNA, 76 nt, Human
gguauacagauuucugggcaaucuaccaaacuuucugagucagaaccuggccaggaaucuguacuuuccaaaugcc

SEQ ID NO: 4197210 - RNA, 75 nt, Human
gguauagccuucuccucugagugacuccauuggugggugagcagcagggauggagcagaggaagaaggcuuuccc

SEQ ID NO: 4197211 - RNA, 95 nt, Human
gguaucacuuggagaauccacuuccaggacagccucacucacacagcuggaagucagugugguugcuggcuuggaccucaguucuccauuuggcc

SEQ ID NO: 4197212 - RNA, 78 nt, Human
gguaucauagucaucuguuuacuuuucugcuucuccaauuaaacaaggagucauguaaucacaaugaccuaagguacu

SEQ ID NO: 4197213 - RNA, 85 nt, Human
gguccuaacacacuguggcucauucuugguggcauagcaaccuaggucuugggugagacugcccaccaggcaguggccagggacu

SEQ ID NO: 4197214 - RNA, 129 nt, Human
gguccugaacucucacuuguguucuauugaucucauuauccaucacugcacugagaugaacucagugcagugaugaauaaugguuuagaaauugucaucuagcuuacuuuugaggaguucaaaaugauc

SEQ ID NO: 4197215 - RNA, 66 nt, Human
gguccugcauugccagcaagcuagaagccacuguucgguaauguuucaguugagaaugcacggacc

SEQ ID NO: 4197216 - RNA, 110 nt, Human
gguccugccauggcuucccacccugcuccccagccacguccaccagccacaccugcacagggugggugcaggucuugugccagggagcauggccgugggugguagugacc

SEQ ID NO: 4197217 - RNA, 71 nt, Human
gguccugcccucucucucuggcugccagcugcuacauccagcugugcacagauucagagguuuugcugacc

SEQ ID NO: 4197218 - RNA, 114 nt, Human
gguccugccuucucugccccucugcaaggcccuccaguagccacccagacccccaaauaggggucgcaagcacggggggccugccaggucuacagggcacugggggccauagcc

SEQ ID NO: 4197219 - RNA, 73 nt, Human
gguccugcuugcagcaggugcuuaggaacaagugugaguugauuuauagcugccugcagcacagcucugggcc

SEQ ID NO: 4197220 - RNA, 70 nt, Human
gguaaauaaagccugucucuuuagaguauaacauuucaaagugcuucggugaauugcaggcuuuaagacc

SEQ ID NO: 4197221 - RNA, 83 nt, Human
gguaaauaaggcagucacuggaauguuccucuccaaauugucagaacagaggaguuuuccagccugauuuucuuuccuccacc

SEQ ID NO: 4197222 - RNA, 125 nt, Human
gguaaauaagugacuuggaaaggaauauaaauacuauguacaggcugucuauaaaaaccaggguagagaauauuuuauuacacuaguagaauaguguuugcugugucauuuccuuacaauuuauc

SEQ ID NO: 4197223 - RNA, 73 nt, Human
gguaaaugcauucucgguuuguguguuggaaaaucuuggaucuuauguccaauacauaauuuaaauguauacc

SEQ ID NO: 4197224 - RNA, 62 nt, Human
gguaacacugcuucauuuuggagagugaucuaaaucuguuauucccaaugagcguguguacc

SEQ ID NO: 4197225 - RNA, 67 nt, Human
gguaacacugucauuuaagacauucuggagcccagguuuccauuugaaaugaaagugauagguuauc

SEQ ID NO: 4197226 - RNA, 73 nt, Human
gguaacauagcauuuacuuuucagaaauuaggugaaguguaacuauuuuaaggaguaaugcuuguuuguugcc

SEQ ID NO: 4197227 - RNA, 92 nt, Human
gguaacugagcagugcuggcucccagcuuucagggagagaaaauuauuccuccucaagcuggcugggagcuauuaaagguuuaaaugucacc

SEQ ID NO: 4197228 - RNA, 66 nt, Human
gguaacuguguuucacugguuaugcuuagcuguaaauccauagcauauacaguuuuacaggguuuc

SEQ ID NO: 4197229 - RNA, 66 nt, Human
gguaacuuaguaaaauaccuuuugaugauuagccucauuaggaauauuuucugaguaguuugugcc

SEQ ID NO: 4197230 - RNA, 68 nt, Human
gguaacuuuucuaacuuuacacucgaaagcaaauucuuuuguuguguguaguguuaaaaaauaugacc

SEQ ID NO: 4197231 - RNA, 69 nt, Human
gguaagaaagauggggcagaauggagccauccaucuggguagccucucuucccgcauucccuuuuaacc

SEQ ID NO: 4197232 - RNA, 59 nt, Human
gguaagaaguacaaaaauuuucuguguagguggauaccagaaggguuugucuuuuuucu

SEQ ID NO: 4197233 - RNA, 129 nt, Human
gguaagagggaacuacuguaauucuaauaugcuguaagggguuauagugauuacuguuaauucuucugagacuaguaacauguaucgcuuuuuaauauccuucaaauuuauuagguucccucaauugcu

SEQ ID NO: 4197234 - RNA, 84 nt, Human
gguaagaucccaggauuuagauuuggaggaacuaacaccuuuuaguccuugagccucuaaguaguguggaaucuaccuuuuacc

SEQ ID NO: 4197235 - RNA, 74 nt, Human
gguaagcaggcaaguuuggaaagcaaggugauaggugauagucuacagcugcaaguaagcuugcuccucuugcu

SEQ ID NO: 4197236 - RNA, 63 nt, Human
gguaagcauaggucuuucuguaucaccuuaagccuggaggcuuacaugaagcugguguuuguc

SEQ ID NO: 4197237 - RNA, 56 nt, Human
gguaagcgcuuuucucgauucccacuuucugacucuggggcauggaugagcuuacc

SEQ ID NO: 4197238 - RNA, 70 nt, Human
gguaagcucagagucucggagggaaaaaggagagacagcaugucuaguuucaucagagaaucuuggugcc

SEQ ID NO: 4197239 - RNA, 75 nt, Human
gguaaggccauggccccuggggcugggccuucugaggaagcucuggccuccuccaccagggaacaugcccaaacc

SEQ ID NO: 4197240 - RNA, 79 nt, Human
gguaaggguaaguggggcagaggccaagcaguacuucucaaacucaagcgugcaauucuguccacgcgaggcccuugcu

SEQ ID NO: 4197241 - RNA, 81 nt, Human
gguaauaaauuaagaauguuccaaaaaauauccauuuguucucagcaauauggagcugugugaauauucauaacuguuacu

SEQ ID NO: 4197242 - RNA, 84 nt, Human
gguaaugagagagucuggugauggucauugucauggacccugugggucagagggcacugucauaggcuaacccacuuaauuauc

SEQ ID NO: 4197243 - RNA, 55 nt, Human
gguaauuacaggaucucucuggcagucuugggaagaggagaaaccugugaaugcu

SEQ ID NO: 4197244 - RNA, 79 nt, Human
gguaauuauaugugaaguggguuauuuugguuuuuguuuauuuaaugaauagaauaacguaguuacacuuaguaauacu

SEQ ID NO: 4197245 - RNA, 76 nt, Human
gguaauucaaaacaaauuucaagcugugacaauaaaaugguucuuguaguagguugggguuugugcugaaauugcc

SEQ ID NO: 4197246 - RNA, 55 nt, Human
gguaauuccuuaagcugaagacuugaaggcaaguccuuucucauggaggaauuuc

SEQ ID NO: 4197247 - RNA, 78 nt, Human
gguaauugaggcacucuguacaaaucugcagguaaaugucaagcacacugacagggcauggugcagaguucugaggcc

SEQ ID NO: 4197248 - RNA, 70 nt, Human
gguaauuugaaggcacugaacuccuucugguaugugaguaauuuuuagugugauuuuaugccuuuuuacc

SEQ ID NO: 4197249 - RNA, 79 nt, Human
gguacaagcucaguggccauggugcggccacagauaagucuugcuggccugcaaagcccggcuguuaacuggcgugucu

SEQ ID NO: 4197250 - RNA, 73 nt, Human
gguacaagugucugaguaaauuucucauugaacuauuuuucaucaguguaaaaauaaucagauuacuaaugcu

SEQ ID NO: 4197251 - RNA, 70 nt, Human
gguacaauguagauguucacuugauuuuuauugaauaaaugaaggaauaagugaguacuuugcagguacu

SEQ ID NO: 4197252 - RNA, 60 nt, Human
gguacacauuuuucuuucucuugcauaaucauauuuuagagagaguuugugucagguacc

SEQ ID NO: 4197253 - RNA, 61 nt, Human
gguacagaugcugccugggaaugucugcccugcccgcagccacuccuucagcgucugcucc

SEQ ID NO: 4197254 - RNA, 61 nt, Human
gguacagcuaguuaaacauuugcaggacaaauauaaccgaauguguagcaggugcugugcc

SEQ ID NO: 4197255 - RNA, 58 nt, Human
gguacaggccaaaagguaauucaaaaagcgaaacgaaucucaucuccugaccugugcc

SEQ ID NO: 4197256 - RNA, 96 nt, Human
gguacagggaacaacauucacccaggccuuucuucuuggucugcauuuugcaacccaaagagugagcgccucuguaaauuuuguacucuaggugcc

SEQ ID NO: 4197257 - RNA, 73 nt, Human
gguacaguuuuuauucaugacaagauucuccauguccaccuuugauuugccucuuguuuugaaaggacuggcc

SEQ ID NO: 4197258 - RNA, 75 nt, Human
gguacauggagaggccgggguuaggaguggggcuugccugccuccagacaagcucgccugccccggaacagugcu

SEQ ID NO: 4197259 - RNA, 66 nt, Human
gguacaugugcacaaugugcagguuaguuacauauguauacaugugccauguugaugcgcugcacc

SEQ ID NO: 4197260 - RNA, 70 nt, Human
gguacauuauuguuagugagacuguagauuuuacucgauuuuaccagaaucucacuaauguccuuuugcu

SEQ ID NO: 4197261 - RNA, 63 nt, Human
gguaccacugugagacacaguccugcuugauuccugggcacagcaccuuuucacauugguacc

SEQ ID NO: 4197262 - RNA, 65 nt, Human
gguaccugccuuuccagucaccacuagaucaggcuucugagccuguuggcugucagggcuggacu

SEQ ID NO: 4197263 - RNA, 97 nt, Human
gguaccuuaagacuauuaugcugaaaaagacauaugugggcauucuggucacuaguccaggugugcccagucuucuagcuauaccugucaaggugcc

SEQ ID NO: 4197264 - RNA, 68 nt, Human
gguaccuuauuguacauuuuucgguuucuaccagcuucuggugacagcauggaagaagugauuggacu

SEQ ID NO: 4197265 - RNA, 55 nt, Human
gguaccuuugccaccucgcagggaauggcgugucccugucuuggacugaggcacc

SEQ ID NO: 4197266 - RNA, 76 nt, Human
gguacugaaguuuugacaucucauuucccaauagcuucccagcuggguccaaguguuauguaggauuucagagacc

SEQ ID NO: 4197267 - RNA, 79 nt, Human
gguacuguagauauuccugacuuaauuuuugacagaaaaguuaaggguaaucuugagucauggcauauauugaaagacc

SEQ ID NO: 4197268 - RNA, 80 nt, Human
gguacuugaagagugguuaucccugcuguguucgcuuaauuuaugacgaaucauacagggacauccaguuuuucaguauc

SEQ ID NO: 4197269 - RNA, 79 nt, Human
gguacuugaagggagaucgaccguguuauauucgcuuuauugacuucgaauaauacaugguugaucuuuucucaguauc

SEQ ID NO: 4197270 - RNA, 76 nt, Human
gguacuuguccaaggucaccugucugggaagugguuuggcauggucuagaaucugggauuucugacucuuagugcc

SEQ ID NO: 4197271 - RNA, 74 nt, Human
gguagaaaaaagaggagugguuuaugacaaguggaauccaaaugucauucaaguggcuccaguuccuuucuauc

SEQ ID NO: 4197272 - RNA, 65 nt, Human
gguagaaacaaccuugacccuuagucgggugaacagcuugcucaccuggcaggagcgagucuacc

SEQ ID NO: 4197273 - RNA, 74 nt, Human
gguagaagagcagagaguaagaggccauaugaaguccuuuagguuaaaugguauucucuaacucagcuuugacc

SEQ ID NO: 4197274 - RNA, 71 nt, Human
gguagaagguucauguauauuuauauuguuaauucagauauacuguguuccauggaccauuucugucuacc

SEQ ID NO: 4197275 - RNA, 62 nt, Human
gguagaggaggauuuguaaaggucucguggaggaauugagaucugaaggucuugcucucauc

SEQ ID NO: 4197276 - RNA, 92 nt, Human
gguagaguacaccgaguuuguuuuauuuugugcuaacccaaugagaaagcauauugguacaaaaccaugaaagaaagcggugguucucugcu

SEQ ID NO: 4197277 - RNA, 73 nt, Human
gguagagucugggagaggcuuggcccagccugggggguaccuaaaacucuccggugcagccucuggauucacc

SEQ ID NO: 4197278 - RNA, 65 nt, Human
gguagagugacggcucaucucuggaagcucaaccuccauguuuccucccaggaccucacucuacu

SEQ ID NO: 4197279 - RNA, 69 nt, Human
gguagaugaggcauauccuccuaugguucaagucagaaugaaccaugcaggcuauuuucaaaucauacc

SEQ ID NO: 4197280 - RNA, 67 nt, Human
gguagaugcauagagcacagcacaucaaguccaccagcauagauggugccaggcccuuguguuugcc

SEQ ID NO: 4197281 - RNA, 87 nt, Human
gguagauggaaggauggaaggugggagaccugucagaaggcucacagcuuaggccucugaaacuccagccccagguuuucccauacc

SEQ ID NO: 4197282 - RNA, 61 nt, Human
gguagauuggggccugucagggacucuaccccuauaguccuuacaggucauccaagucacc

SEQ ID NO: 4197283 - RNA, 64 nt, Human
gguagcagcucugagcaugcugcuaguuccccauagugccugcagauggccccagagugcugcc

SEQ ID NO: 4197284 - RNA, 59 nt, Human
gguagcagcugugaguaaaagccaucaccagguagauaggaggagaccgcaguguuacc

SEQ ID NO: 4197285 - RNA, 65 nt, Human
gguagcauaugcaguuuuacagaugaagaaacuaggauguaacuugccugggacucaaugcuacu

SEQ ID NO: 4197286 - RNA, 57 nt, Human
gguagcaugcacuguugagcgccauccauccacauggcugcccaacccugcaucucc

SEQ ID NO: 4197287 - RNA, 62 nt, Human
gguagccagcaauaaggugcuguugcagcucagcccugcuugcagucacucgguuggcuacc

SEQ ID NO: 4197288 - RNA, 76 nt, Human
ggucgaggcagguggaucaccugaggccaggaguucaagaacagccuggccaagauggugaaaccccgucucuacu

SEQ ID NO: 4197289 - RNA, 71 nt, Human
ggucgaugcugcccuguuuggacagcccggucuuccggggccgcacguuguccagcugggcaucguccacc

SEQ ID NO: 4197290 - RNA, 108 nt, Human
ggucgccgccgcagccuccgccgccgccgcagccgcugccgccaccgccgccgccacugucgcugcugucgccacggucgccgcugccgccgggccgcugccgcgacc

SEQ ID NO: 4197291 - RNA, 63 nt, Human
ggucgccguccgccgccugggccgacaggagucaccuuugagccugggcgcggacccguugcu

SEQ ID NO: 4197292 - RNA, 66 nt, Human
ggucgccugcucagcccaugagcaaccacuguggacaggguauugcgugugugcugaggggcgucc

SEQ ID NO: 4197293 - RNA, 125 nt, Human
ggucgcgcucacugcagauuggagaacaggugcaucucguagcucuucuuuggaaacaaaagaagccaccagcugaggaagaugcucaccggucaccgucccuuuauuuaugcccagcgaugacc

SEQ ID NO: 4197294 - RNA, 76 nt, Human
ggucgcuuaaaucccaaugcuagacccgguggcaaucaaggucuagccaccaggucuagcauugggauuuaagccc

SEQ ID NO: 4197295 - RNA, 58 nt, Human
ggucggcggcguggugccugcugcugccgccgcggcagcugagaucaugcuguugauc

SEQ ID NO: 4197296 - RNA, 90 nt, Human
ggucguauggagguuuagucacuggaauagcauugauucuugauuaaguggagggucuaacaaucuguucuaucuacaucucaucugagu

SEQ ID NO: 4197297 - RNA, 56 nt, Human
ggucgugaauugaaucaguggccaaccaaagcugcugacucccaaaauacaugacu

SEQ ID NO: 4197298 - RNA, 88 nt, Human
ggucguuuaucgauacaaagugaguguuggaggaacccaucaagacacaggaagggggaaauccuagcgccgccagucggagaugacc

SEQ ID NO: 4197299 - RNA, 58 nt, Human
ggucuacaguucuguccuagacuucguucggcugaucgaugaaggagacaagcuggcc

SEQ ID NO: 4197300 - RNA, 74 nt, Human
ggucuacugcucucccuccucccugcccaggccaaccuuagaaccagggcagggcugggugggagacagagacc

SEQ ID NO: 4197301 - RNA, 59 nt, Human
ggucuacuguugguggaauugacagaauuacggaauuguuaagagcuuagcaguaggcc

SEQ ID NO: 4197302 - RNA, 72 nt, Human
ggucuagaaucuaaacuauaguuugaugaaagcuuucauuuauauaaaaauugaggauugagauuguagacu

SEQ ID NO: 4197303 - RNA, 65 nt, Human
ggucuagcuaccugaacaaugcagacugcgucccuucgcagcuguggaguggggaguacuggucc

SEQ ID NO: 4197304 - RNA, 77 nt, Human
ggucuauuguggccacuguuucuuuuccucuggauuccuuuuaggugggagguaggagaaacagggccacaguugcc

SEQ ID NO: 4197305 - RNA, 56 nt, Human
ggucucacaggacuaaaagcaaagugucagaaaggcuguguuuccuccuggaggcu

SEQ ID NO: 4197306 - RNA, 66 nt, Human
ggucucagaguccuggggaugggaguggccugagccgaaccacauucaguccaggcuuggagugcc

SEQ ID NO: 4197307 - RNA, 61 nt, Human
ggucucagcaggggugucauuguaguuauccccugguagcuccugcagacuccugcucacc

SEQ ID NO: 4197308 - RNA, 56 nt, Human
ggucucagcaguugcuuugacuccuggguaaucugaaucacaaagcugccggggcc

SEQ ID NO: 4197309 - RNA, 58 nt, Human
ggucucaguccgugcuguucaggugagcugaccacaagacaccugggguggacagacc

SEQ ID NO: 4197310 - RNA, 130 nt, Human
ggucucauguccuuauggcauauggccagugaagccaagggcugcuuuuccuaauuccaguaugaacaauaccagauaaggacaauuagucuggcuuggcucaaauguccaucccuuaggcaagugcucc

SEQ ID NO: 4197311 - RNA, 87 nt, Human
ggucuccauuccugcuccucaggagcugcuggucucacggaagcuccugauacaugcaggaauaauuucaaauggagcauaaaagcc

SEQ ID NO: 4197312 - RNA, 67 nt, Human
ggucuccugaccuuuagucccuugcucuuuccacuaaaacaagccaccaaaggugaucaggaucacc

SEQ ID NO: 4197313 - RNA, 130 nt, Human
ggucuccuguauacacucucauaggcugugcacugcauaacuccagagaauccauccauucagacugugaugaguggugccuacuggaauugaggagugcccaaccuguacaacugucaauaacagcccu

SEQ ID NO: 4197314 - RNA, 77 nt, Human
ggucucgccucacuauggcagcggcauggcacagcacacucgacuucaugcucagcgccaaagcugauggcgagacc

SEQ ID NO: 4197315 - RNA, 75 nt, Human
ggucucuaagggcgcauggacugguguuucccagacuguggucuccagggacacacuagccggcuagugccugcc

SEQ ID NO: 4197316 - RNA, 75 nt, Human
ggucucugcucauauuuuuuaucuuuccugcaucuauucaacaggugacaaagacaaagauauguccaaaugacc

SEQ ID NO: 4197317 - RNA, 66 nt, Human
ggucucuggcagcacuagguacugagcugugggagcaguguuguaugggaugacugcuuuaguacc

SEQ ID NO: 4197318 - RNA, 56 nt, Human
ggucucuuugcuucagcuacagcuggcuguuugcugccccucaagcagaugaaacc

SEQ ID NO: 4197319 - RNA, 103 nt, Human
ggucugaaaaccagugaccuaagacaacaugaucagcaguccuucccagauaauaauuauuuuuccaggauuuguuuauaggucuuaaagugacuuucaggcc

SEQ ID NO: 4197320 - RNA, 62 nt, Human
ggucugacagcuccuagugcucacuuugugauaugggucagugagugcuuggagcaucagcu

SEQ ID NO: 4197321 - RNA, 86 nt, Human
ggucugagaucuuauuccaacuucacuauugucuaguaauguccuuuguagcaaaagacaguucugaguugggauaguuucaugcc

SEQ ID NO: 4197322 - RNA, 55 nt, Human
ggucugcccuuccucuccacgaugcuaccuugaagcaucugaaguaggugcagcu

SEQ ID NO: 4197323 - RNA, 69 nt, Human
ggucuggaaagguauuugucucaccuagggucagccucaagauuccuugagauaggacauuuccagauc

SEQ ID NO: 4197324 - RNA, 71 nt, Human
ggucuggauucagagcacagaagaauaggugcugucucuccagcacccagcaucugugccuaacuccagcc

SEQ ID NO: 4197325 - RNA, 70 nt, Human
ggucuggcaaaugcccuagggcugccuucucuucuuuagaggacuggguaggagcccagggccucagacc

SEQ ID NO: 4197326 - RNA, 68 nt, Human
ggucugggaacaccugcugcccaguggucugggaacaccugccacugggcagcagguguucuucaguc

SEQ ID NO: 4197327 - RNA, 59 nt, Human
ggucugggcuugaguccuuuugggaugaauauaaacagaaggaacuuuagaacauggcc

SEQ ID NO: 4197328 - RNA, 79 nt, Human
ggucugggggcuuaggcugggcuuuggugggagccaccgcugugauggccccuggcaccaggcugauuccuaccagacu

SEQ ID NO: 4197329 - RNA, 66 nt, Human
ggucugucauauauucugguuuucacugguccucaggccaggcaggcuagaauguaaauucaggcc

SEQ ID NO: 4197330 - RNA, 70 nt, Human
ggucugugcaguuacuagcugguagaaaugaaaacaaagauugugauuagcuguuaguaguguauaugcc

SEQ ID NO: 4197331 - RNA, 127 nt, Human
ggucuguggccuguuaggcacugggcugcacagcaggaggugagcagggagcaagcuagcacuagggcccaagcuccgccuccugucggaucaguggcagcauuagauacucauaggagcacagacc

SEQ ID NO: 4197332 - RNA, 96 nt, Human
ggucuguuaaaaagcugugugccauuccagcuuucuagguauuucuggugugacuuuucuggggccagcggggaggacucagcucuuucucagguc

SEQ ID NO: 4197333 - RNA, 73 nt, Human
ggucuuacugcuggggauccuuuuugcaucuagggccccgugccuugagaaagugggugccuagcaacuagcc

SEQ ID NO: 4197334 - RNA, 80 nt, Human
ggucuuagagccagagccccagagaacaguggaacaucauugaugagcuuugucccuugggggcucagggcucuucuacc

SEQ ID NO: 4197335 - RNA, 103 nt, Human
ggucuuaguucucuuuauuagaauuguuucuauuugccaaaguaacucaagcacuuggaacaaauuaaacaauacagggauagauaaagagaaauguagcauc

SEQ ID NO: 4197336 - RNA, 109 nt, Human
ggucuuaguucugcagcgacaucuuauggaguugguuaguuugcacaaccauuuaauaaugucugccagaacugaucauuguucuaacagauuugaugcaaauaggauc

SEQ ID NO: 4197337 - RNA, 70 nt, Human
ggucuuauugcaagguuugugaaaaacaugauagcauuguuguguugauauagaaaucuuauaaaagacu

SEQ ID NO: 4197338 - RNA, 100 nt, Human
ggucuuccugaaaccagcgggcuuccugaggaaugugaagagaaccaggucaccugggauuucuuccuuccucagaaggucuccccaagucaacaucgcc

SEQ ID NO: 4197339 - RNA, 61 nt, Human
ggucuuccugaaggauggcagccuccccagcagcaggugagguugauccagcaggacuucc

SEQ ID NO: 4197340 - RNA, 88 nt, Human
ggucuugagugugccaagguugugcaccuaaaugcauuuauucauuccccuaacauuuacuaggcacccacuuaggccagucaaugcc

SEQ ID NO: 4197341 - RNA, 99 nt, Human
ggucuugcaaauaaauucaaauuuuauucuacaugcaauagagauuuacuggagauuguaaguagaacaacauaaucugauuugaguuuuugcaaaguc

SEQ ID NO: 4197342 - RNA, 59 nt, Human
ggucuugugauuuggggcaagggcagaauccacugcccugaugauccuccucgcacacc

SEQ ID NO: 4197343 - RNA, 80 nt, Human
ggucuuuaguggcugguuuccugcaugcaacauauuuucaagauucauccauguuguagcaucaaucaguacuuuauucc

SEQ ID NO: 4197344 - RNA, 74 nt, Human
ggucuuuaucuuugaaauuagucugcuaucgguuuuauuaggcauaaugugacaaauuuucgggauaaaguacu

SEQ ID NO: 4197345 - RNA, 57 nt, Human
ggucuuugccugucuuuuagagccugccaacaccucucaaagagccagguaaucacc

SEQ ID NO: 4197346 - RNA, 58 nt, Human
ggucuuuggacucucucuccuuccuuugcagauggaaaggcagagaggaccagagacu

SEQ ID NO: 4197347 - RNA, 68 nt, Human
ggugaaagggucaaggcuacauggagacccagacccaggugaggucucugaugcuuugaccacucacc

SEQ ID NO: 4197348 - RNA, 60 nt, Human
ggugaagccagauuaucacaagccaugaaaaccuucuggaggugacgucugagcuuuguc

SEQ ID NO: 4197349 - RNA, 100 nt, Human
gggagucauucucaaacuugggcaugcaucagaaucaccuagagggaucuauacaccucccuucuagaguuucugaugcaacaggucgaggaugaugacc

SEQ ID NO: 4197350 - RNA, 67 nt, Human
gggaguccagggagauggcagaggcuggcauccuugacagcaucuguaggacuccucuuacauuccc

SEQ ID NO: 4197351 - RNA, 91 nt, Human
gggaguccuggugcaaguaauuggcgaggaguuuagacaauugugcaaccuggaugucuuugccaugcaugugucaggguugaacacuucc

SEQ ID NO: 4197352 - RNA, 63 nt, Human
gggagucugaaaguauguuguaaugcauagucuuguauagcuaugcuuugagauguaauuccc

SEQ ID NO: 4197353 - RNA, 84 nt, Human
gggagucuuugaagucuugcuuucuggcccauuauuauaauaaaucugccaguuugaugauggcuuaguggcagggcgaguccc

SEQ ID NO: 4197354 - RNA, 95 nt, Human
gggagugagagaggaagacucaaagcacuggggaaagccugcuaugaaaaugccaggccuuucuuggggcuuagaccgucaaccuaauccuagcc

SEQ ID NO: 4197355 - RNA, 90 nt, Human
gggaguggagggguauagauuugaggaauagaaauuaaaauagaacuuaaauuaccaucgucaaaucauaugaaagcucuuuuuacucuc

SEQ ID NO: 4197356 - RNA, 59 nt, Human
gggaguggggaggggugggccuguggcugcaggugcagugggcucaguccuccaacccc

SEQ ID NO: 4197357 - RNA, 85 nt, Human
gggaguguggauuuuaucagaaguaucuugggaaggcacuggacaauuucaagcaagaaagauacaugacuugauuuacauuucc

SEQ ID NO: 4197358 - RNA, 77 nt, Human
gggaguuagcaaagaagcaggcaauauuuuuaacuuguaucaucgggcaggaaaaggccauuguuucucugauuccc

SEQ ID NO: 4197359 - RNA, 110 nt, Human
gggaguuccucauuugccaugaguggacaccugcuucuuuacugcuucaaagugaacacagcuauuccuuguaaaggguagguuuuacuguaaggaaaucuagaacaccu

SEQ ID NO: 4197360 - RNA, 63 nt, Human
gggaguugugguuggcuucuggaaggugcuccaggacggcauagauggcagccagcugcuccu

SEQ ID NO: 4197361 - RNA, 62 nt, Human
ggguuuccagacacugccugccucagcuucagcuuagcccuugggcggguggacuggagccc

SEQ ID NO: 4197362 - RNA, 65 nt, Human
gggcgcggcggcgcgggccccgccgaggggggacaccuggcugaggcacagcugccgccgugccu

SEQ ID NO: 4197363 - RNA, 67 nt, Human
gggcgcggcggucagcgugggagaggcugcaggcccugcacgccucugcagcugccgggccgugucc

SEQ ID NO: 4197364 - RNA, 79 nt, Human
gggcgcguggcgacggguguaugcucccagccacauuaccugguguggaaguggcucagcauucacuggucuugugccc

SEQ ID NO: 4197365 - RNA, 67 nt, Human
gggcgcucaccugccugcaaaugccgaaggccaggcggcuaggcucggaagcagcagggagccgccc

SEQ ID NO: 4197366 - RNA, 87 nt, Human
gggcggagaaggguccauugaaucccauccaacugcaucugugcccuucagaucaggauuacacggggaugcuaaaucuccuagccc

SEQ ID NO: 4197367 - RNA, 60 nt, Human
gggcgggauggcaggaggaggagggaaacugacccuacgcgccucugcgcuguccugcuc

SEQ ID NO: 4197368 - RNA, 64 nt, Human
gggcgggccugucgucccagcuuccgcucuccagcauuuuccuaaugcugcuggggcgccgucc

SEQ ID NO: 4197369 - RNA, 101 nt, Human
gggcggggcggggcggagcgggagcugcgggauuccggcuucaggggcggggcaccggccucugggcggagaucugcugccgcguucuacccuuccggccc

SEQ ID NO: 4197370 - RNA, 58 nt, Human
gggcguaucaccugaggucaggaguuugagaccagcuuggccaacauggugaaacccc

SEQ ID NO: 4197371 - RNA, 75 nt, Human
gggcgucaccuuggagacagcagcugaggagcucaaauagguguuaccguggaagcuccugucucaagggagccu

SEQ ID NO: 4197372 - RNA, 75 nt, Human
gggcgugagagcaguuaacugggcucugaucccaucucugagaucuugagcaaguugcauccccucucugagccu

SEQ ID NO: 4197373 - RNA, 76 nt, Human
gggcgugaggcucacugccugggagagggcagccagcaccgacugcucugccagcccaaggcgcagccguccgcuc

SEQ ID NO: 4197374 - RNA, 56 nt, Human
gggcgugauuuggagucugcuagccaggaggccacaggagaaacacaggucagccc

SEQ ID NO: 4197375 - RNA, 115 nt, Human
gggcuaaagucaaggugucagccgggcugguuccuucuggaggcucuaaggggagaaucuauuuauuugccuuuuucagcuucuagaggcugccuguauuucuugacuugcaccc

SEQ ID NO: 4197376 - RNA, 115 nt, Human
gggcuaagaucaagguauuaguagggcuuguuccuucuggaggcuguaaaggagaaucuguuuccuugcuuuuuuucagcuuccagaggccaccccauuccuugguucauggccc

SEQ ID NO: 4197377 - RNA, 55 nt, Human
gggcuaagcagagugggaacagggaccaacgccaccugcuuccagugcucagccu

SEQ ID NO: 4197378 - RNA, 59 nt, Human
gggcuaagcucgcccagggccaacaaacgcugagcucuccacccgggccggcaaggccu

SEQ ID NO: 4197379 - RNA, 60 nt, Human
gggcuacagaaaaucagccacaggccgcauuuggccauugggcuguaguuuuuugacccc

SEQ ID NO: 4197380 - RNA, 71 nt, Human
gggcuacagguauauagaugaaacaagauugccuuguuuauacuauucuaucuacuuuguaccuguuuucu

SEQ ID NO: 4197381 - RNA, 85 nt, Human
gggcuacgcaaagagugggcucuggacaaacccuugcuuuuuccugguccaaaaaggcugagggccgcauagggucauacucccc

SEQ ID NO: 4197382 - RNA, 64 nt, Human
gggcuagaaguuagcuagagaaaugcuggccucaaaaucugcucuucuuacuaauuuccagccu

SEQ ID NO: 4197383 - RNA, 57 nt, Human
gggcuagggaaggcaggcuugggagcagcauccucaucagccucagucuguggaccc

SEQ ID NO: 4197384 - RNA, 73 nt, Human
gggcuaggggcucagggcaguauggcugagagcuggucccccuuggaggucaacuguucuguggaccuagccu

SEQ ID NO: 4197385 - RNA, 59 nt, Human
gggcuauagcacuauguaugggauccacuuuuuccaguucaugcauacuugcauaguuu

SEQ ID NO: 4197386 - RNA, 59 nt, Human
gggcuauggccugacugugcugccaaacagauugccugggagcuguggggccuagcacc

SEQ ID NO: 4197387 - RNA, 129 nt, Human
gggcuauguggguuuauucuucuagguagauguuuacagagggauuaucuaaggguacaaaaaaucagacaguacuuuuaggacaaaucuuuuucuuuauaucuaggaaauaguagacuuacugcauuc

SEQ ID NO: 4197388 - RNA, 130 nt, Human
gggcucaagagauccuccugaguagcugggacuacaggugugugccaccauaccuggcuaauuuuuuuguauuuuuuguagaaaugggguuucaccauguuucccaggcuggucucgaacucuuggacuc

SEQ ID NO: 4197389 - RNA, 58 nt, Human
gggcucaggaaggcucaaccaggacuuaacagcaguuuccgaagggccuucugagccc

SEQ ID NO: 4197390 - RNA, 61 nt, Human
gggcucaggucagggcaucagcauccaguuuuacagucuuugaggcgccugccuugagccu

SEQ ID NO: 4197391 - RNA, 58 nt, Human
gggcucagucuggcguggaaugaucugugaccacaggcuguaccauaaugacuggcuc

SEQ ID NO: 4197392 - RNA, 59 nt, Human
gggcuccaaaguaagcuuuaguuugaaaacauaucaauaagagccaacacugcgagcuc

SEQ ID NO: 4197393 - RNA, 58 nt, Human
gggcuccaggugcaugccaggcuguggaucugccgagcuuccuagugaccuggagucu

SEQ ID NO: 4197394 - RNA, 56 nt, Human
gggcuccggggucagcagcggagacagagaagaccccugcucaggccaaggagccc

SEQ ID NO: 4197395 - RNA, 55 nt, Human
gggcuccuguuugagaaaaagcccgaagaaugguucauuuccaagaagagagcuc

SEQ ID NO: 4197396 - RNA, 75 nt, Human
gggcucuagucaagaaugaauucgagugaaggaaagcugugugacacuuggccuuccucuauguucauggagcuu

SEQ ID NO: 4197397 - RNA, 108 nt, Human
gggcucuauucugcaucuuucucacucugugauccaggcucacugaguccucauccuuuggacuaucaccagucauuacagcaggcagaaggaggaaugugaugacuc

SEQ ID NO: 4197398 - RNA, 57 nt, Human
gggcucugcgcucagcuccagcgagaccaacaauagcucccgcggggagcggagccc

SEQ ID NO: 4197399 - RNA, 56 nt, Human
gggcucuggggucagacagccuggguucgaaucccagccucacuguuccauagccc

SEQ ID NO: 4197400 - RNA, 57 nt, Human
gggcugaaaggccgccucagaugcuccugcacauagcggaagguggcugaacaguuu

SEQ ID NO: 4197401 - RNA, 117 nt, Human
gggcugagcugcucuggccccugcugcccugauguagaaggcucugagcugccgucagggaagagucacggagcucagaaccuccucaucccacuaggaccccaagcagcuuggccc

SEQ ID NO: 4197402 - RNA, 95 nt, Human
gggcugaucccucccccagcucugcugggucccggggccacagcgucaggccgguggggguggagguagaggugggagagcaggggagagagccu

SEQ ID NO: 4197403 - RNA, 59 nt, Human
gggcugcagagggaggggcucgcagccaguuguucuagcugcuuuccgucugcagcacc

SEQ ID NO: 4197404 - RNA, 80 nt, Human
gggcugcaggaugcgcaagccacacagccuggggggagucagagacgacucagggcugcacuggcuggucuccugggucc

SEQ ID NO: 4197405 - RNA, 81 nt, Human
gggcugcaugccuguccccgccugucugagaaagcaggcggggccucccucugcugucucagaugggccaggccccagccc

SEQ ID NO: 4197406 - RNA, 77 nt, Human
gggcugccaucugagaagcgggagccugugaagaagcaucucucccucgcuaucuucugcuucauccgaugcagccc

SEQ ID NO: 4197407 - RNA, 89 nt, Human
gggcugccugccaggugccagggcgcggcucuggccucccgcugcacaacccacuuugccgccaagcccuguacccggcccagcagcuc

SEQ ID NO: 4197408 - RNA, 61 nt, Human
gggcugcuauggaggaagaaacaccuuaagaugagguuguuuaauaauucuaugauagucc

SEQ ID NO: 4197409 - RNA, 62 nt, Human
gggcugcugccaaucacagccucccagcauccagggcucagaggaagaugggcagcuugucc

SEQ ID NO: 4197410 - RNA, 60 nt, Human
gggcugcuuauacugaugauaaccccccaaaaauaguucucucaauaucaguugcagccu

SEQ ID NO: 4197411 - RNA, 60 nt, Human
gggcuggagaugcuuauggagaguuccagggaauguuucuucucaguaggcuuccagcuu

SEQ ID NO: 4197412 - RNA, 126 nt, Human
gggcuggagcagaugauuuuagaagucucuuucaguucugauagucucugauuuuguggaauaguagaucucaacacuggaaguacaucagagucguguggaacuugugaaaaacuguuccagucu

SEQ ID NO: 4197413 - RNA, 87 nt, Human
gggcuggagggcugcuggucugggcccaggccaagaaaauaucugaaggccagauuccaggccuggggccaaguucucaaagugccc

SEQ ID NO: 4197414 - RNA, 99 nt, Human
gggcuggaggugguggagcugcccugggauggucugugcgcagagggcgcuggagacccucucuggguguucuuggagcugccauagcugguccagccc

SEQ ID NO: 4197415 - RNA, 80 nt, Human
gggcuggcacugguguucgggcucguuuugcaugugcugccucugugccuguaacugguccugaacagcccagguuaccc

SEQ ID NO: 4197416 - RNA, 63 nt, Human
gggcuggccaaucacggcacugaauuccucuugcuagcgauucauguagugauugagucacuc

SEQ ID NO: 4197417 - RNA, 100 nt, Human
gggcuggcugaggccccucuaugugcaccugggugggcagucggugcaggugcaggccucacagacgcauccucagguagaagagguuucagaggagccc

SEQ ID NO: 4197418 - RNA, 108 nt, Human
gggcugggacuuuugauuugucauguauguaaaguugauauuuauuuguugugucucuggcuuguuaaugcauauugcaagucucuaccaacugagagucauaagccu

SEQ ID NO: 4197419 - RNA, 99 nt, Human
gggcugggcaaucucccugucaguguuuauugcgguguguacuaggucuuaugcugcaugcuauggugauacugagagguagaagacagaauccugccc

SEQ ID NO: 4197420 - RNA, 92 nt, Human
gggcugguccucagagagugggcccacugccuucagccugaggucaagcagccuaggucugagucccagggguacccucuuuccuccagucc

SEQ ID NO: 4197421 - RNA, 82 nt, Human
gggcuggugcaguagaagagcuuccaccuggggcugcgagaaagccgccugcagccagggaguucucuccucauugcagucu

SEQ ID NO: 4197422 - RNA, 76 nt, Human
gggcugguggaggggaaagugugaggcugcgcucuaagagaugcaggcgccucggcccuucccgccuccgucaccc

SEQ ID NO: 4197423 - RNA, 61 nt, Human
gggcugugccucaggugggguccacauagucugguguggucaucucuccugggccagcgcc

SEQ ID NO: 4197424 - RNA, 102 nt, Human
gggcuguggagaaccucccgugccgucucacaggugcacguggcugugggccgcuccaaggucaggcucuauguggacugccggaagguggcugagcggccc

SEQ ID NO: 4197425 - RNA, 80 nt, Human
gggcuguggcaauucucugggaaagauugugcaggcugugaccgagcccgccaagauuuuccagacccuugcaaccaccc

SEQ ID NO: 4197426 - RNA, 55 nt, Human
gggcuguguaaugugcucuuuucccaacaccaaagggugaguauaaugcaagccu

SEQ ID NO: 4197427 - RNA, 55 nt, Human
gggcuguguccacaaggccugcccugccagcggcacugaaccaggacacaagccc

SEQ ID NO: 4197428 - RNA, 72 nt, Human
gggcuguguccccgcugccuccccuuugaccuccccuuugaccucugcgggagggagcuggccacacagccu

SEQ ID NO: 4197429 - RNA, 87 nt, Human
gggcuguuagugaauaauauuguuuauaaaacaaugcacccagauaaaugucaagguauuauaaaaaguauuguuuauuaucagcuc

SEQ ID NO: 4197430 - RNA, 60 nt, Human
gggcuguuugcauauguuuauagaguauuuaguuuacucuaaaagaugacaagacagcuc

SEQ ID NO: 4197431 - RNA, 97 nt, Human
ggugcucauucagagaggggcugucaucugggagccugugccccuggguccucgaggguuauggcuugucccuggucaguccugucugaucgaggcc

SEQ ID NO: 4197432 - RNA, 101 nt, Human
ggugcuccaggggugguaugaacaacaaaauguagaagcugacagugcuguccccaccuacuggggacauaccacuucuauucaugcugcuuaaggcuacc

SEQ ID NO: 4197433 - RNA, 72 nt, Human
ggugcuccgggcccaccugacugggcguccucugagucagggaggugccagugcugugguccccgcgagccc

SEQ ID NO: 4197434 - RNA, 59 nt, Human
gguggggaggggcuggcaccaggcagcacugccuggcccugcuuaugucucucuuggcc

SEQ ID NO: 4197435 - RNA, 102 nt, Human
gguggggcgccaggauggcuccugggggugcuccugccgccuuccuucacggcacuuacaaccggcgggacccccagggaccaccccucagggcgccccccc

SEQ ID NO: 4197436 - RNA, 67 nt, Human
gguggggcuggccucuuugcaccucuuucuuguuaccugacagggcugcagauagccagccaccacc

SEQ ID NO: 4197437 - RNA, 59 nt, Human
gguggggcugggagaggccccucuguggagcucggaacagucgcuuuccuugccccucc

SEQ ID NO: 4197438 - RNA, 56 nt, Human
ggugggggagaugcuuagguccggggaaucucugagauucucggcuuccccucucc

SEQ ID NO: 4197439 - RNA, 100 nt, Human
ggugggggaggcagguggagaggaacccagacagggcuuugcagccagguugguucucagaguuggagucuggacuuccuugcuaacuugcucucugacc

SEQ ID NO: 4197440 - RNA, 76 nt, Human
ggugggggcuuaaagcaacaauaguccuggaaccgauaacaguguuccuggaacauuggcauuuuaaggcuucacc

SEQ ID NO: 4197441 - RNA, 129 nt, Human
gguggguaaugaggugcauaugugaaaucucggugcccaugucucugcucaaugagguaucuaucagcuguuugggacuuuaggugagaaggcauuuauuucacucacugauguugaaaucauccuacc

SEQ ID NO: 4197442 - RNA, 61 nt, Human
gguggguauugaauacaggugugcuucaucccauuccccagcugucuuucauuaccucauu

SEQ ID NO: 4197443 - RNA, 56 nt, Human
ggugggugagcccugggagcugagucugcggcccggcucugcgcagcucaccugcc

SEQ ID NO: 4197444 - RNA, 101 nt, Human
gguggguggggacaaggcuuuggcuaagcaugcuccagcugcaggcgcccucugugugugcuguuggaggugcuggagccagaacuuggucuugaccugcu

SEQ ID NO: 4197445 - RNA, 64 nt, Human
gguggguggugaagucugguuuaagacuauccuuugggucuaaacagccucuuaccaacuuccc

SEQ ID NO: 4197446 - RNA, 83 nt, Human
gguggguguccacagcaucccagagcccagagcugggaccuucugcugcccuagcugcacugggaccugcuccagcauccucc

SEQ ID NO: 4197447 - RNA, 93 nt, Human
gguggguuuaggggagcuguccugugcacuguagcauguuuaacagcauuccuggagacuacacacugagugccauaggacccucugcccacc

SEQ ID NO: 4197448 - RNA, 61 nt, Human
ggugguaguggugguguccaaauuccugacucuuuuguuuggaacacuuucaguagcuauu

SEQ ID NO: 4197449 - RNA, 75 nt, Human
gguggucaaaacuugucaccauauuucauuuugaacaauaucaaacuaagugugggaggcagaauguugaccccc

SEQ ID NO: 4197450 - RNA, 61 nt, Human
gguggucaggcagugggagagaacuggaguccuccucaguucucacugcucucugaccacc

SEQ ID NO: 4197451 - RNA, 68 nt, Human
gguggucauggaagguccuaccuagaagacgauaucugagcuaggauaguuaaugaugauuuugcacc

SEQ ID NO: 4197452 - RNA, 62 nt, Human
gguggugaagucugcaggcucuaaaaccagaaaacacagguucaaguccuggcucuaccacc

SEQ ID NO: 4197453 - RNA, 59 nt, Human
gguggugugaucuccucaacuagacuguaaucugcuuucaggacagggaucacaucauc

SEQ ID NO: 4197454 - RNA, 55 nt, Human
ggugguucacaccuguaacuccaacacuuugggaggcuaaggugggaggaucgcu

SEQ ID NO: 4197455 - RNA, 55 nt, Human
ggugguucacgccuauaaucccagcacuuugggaggccaaggcagguggaccacu

SEQ ID NO: 4197456 - RNA, 55 nt, Human
ggugguucacgccuauaaucccagcgcuuugggaggcagaggcgaguggaucauu

SEQ ID NO: 4197457 - RNA, 104 nt, Human
ggugguuggaggaagacccuuggugaaauguagucuugugagauaugcucacaggggccaacucucagcuugagcuacaugcccaggcuucuaacccgaccacc

SEQ ID NO: 4197458 - RNA, 66 nt, Human
ggugguugugagggugggcuagccacggguugggggaaucauaaugccagcuuucccugcagcauc

SEQ ID NO: 4197459 - RNA, 83 nt, Human
gguguaaggcauuggucuuuuuccaguucccucacuuaucuccaagaaaagagggcucugaaaggaggucacugcuaaacauc

SEQ ID NO: 4197460 - RNA, 76 nt, Human
gguguacacauugucuguuuacuucuugucugaacuaucauauuugaagcugugaaguguaagauaaaugugcauc

SEQ ID NO: 4197461 - RNA, 72 nt, Human
gguguagacucaggcauauaguaggugcucaaugaauucuuauuaaacagagaugccugggucugggacacc

SEQ ID NO: 4197462 - RNA, 114 nt, Human
ggugucacacaggguaaugcugcuuuauuaacuacuccuuuagccuuuugggaaguagagaguguaggagagagguuuuaaauggggucagaagagggcauuaaaaaugacauu

SEQ ID NO: 4197463 - RNA, 92 nt, Human
ggugucagaugcccuggccagccagaaccaaaagcauggaguagacgcuuggcuuuuauuccugguguuggcugggucccuguguccugccc

SEQ ID NO: 4197464 - RNA, 58 nt, Human
ggugucagccugggagccuagcauucuagcccuuugcaaggcugccaggucucacauc

SEQ ID NO: 4197465 - RNA, 57 nt, Human
ggugucagggcuccacucacccucccugcaccacccagggggggcuugcccugcacc

SEQ ID NO: 4197466 - RNA, 58 nt, Human
ggugucaguugcucaucagaguuguucuuuuauuuuauagaugaugcaacugagcucc

SEQ ID NO: 4197467 - RNA, 84 nt, Human
ggugucauaaauuuagcagccagagucugaacauuaggguggcauaauauauccuaugucuccauguguuguuaguuuaucacu

SEQ ID NO: 4197468 - RNA, 72 nt, Human
gguguccagaaagaaguggggauagaggucuuuaaccauaaauauugcagcuucuccauucuucuggcugcc

SEQ ID NO: 4197469 - RNA, 55 nt, Human
gguguccuacugcuugguugcucaguguggguuggggacuuggcaagggaacacc

SEQ ID NO: 4197470 - RNA, 75 nt, Human
ggugucggcuguacaaaggcagggacuucaucuaugugauucacuccugugcaggccugccucacagucagcacc

SEQ ID NO: 4197471 - RNA, 55 nt, Human
ggugucguccuguuguagcugggauacugucucaggccagcagcaugacggcauc

SEQ ID NO: 4197472 - RNA, 71 nt, Human
ggugucucugaaagguauaaauaagacuuacucuuuugcuguaagauuccauaccuuuuaggucagacucu

SEQ ID NO: 4197473 - RNA, 81 nt, Human
ggugucucuguggcccuaggguagggcucuacugcagcccuaggguagagagcuaggccacuggggcuuccagauugcacc

SEQ ID NO: 4197474 - RNA, 55 nt, Human
ggugucuguggccucagcagcugucagagaggagcucagagaaucagcagacacc

SEQ ID NO: 4197475 - RNA, 82 nt, Human
ggugucugugucagggcugagaaugacagggccgggcaaguccaaaccugccucuucucaugccaucgucucacauggcgcc

SEQ ID NO: 4197476 - RNA, 79 nt, Human
ggugucuguugccuccugguuaccucagcagcucccuaggguucacauggcuaguuuagccaggcccagcauggacacc

SEQ ID NO: 4197477 - RNA, 68 nt, Human
ggugugaaaucugaugaauugaccucagauuccccaguucaggacaucaaauugucagauuuuauccc

SEQ ID NO: 4197478 - RNA, 67 nt, Human
ggugugaaugcagguggccgucagaagggcuguccaccuuccuucagggggccgccugcaccagacc

SEQ ID NO: 4197479 - RNA, 112 nt, Human
ggugugagacuguuuugagcauuuuguaaagcugauuagaaagccaaugcuuugccaaaaugaggaguaccagguuaucuaagacaguuuggcauuuggcugaaauugcacc

SEQ ID NO: 4197480 - RNA, 70 nt, Human
ggugugagagaagcugccauggaggagagccuagaauccugaaagucaucuaggauagugaucucaugcu

SEQ ID NO: 4197481 - RNA, 77 nt, Human
ggugugagauuuuccagcaugaugcucacacaaaaccccgaaugugagguugggggugaguacagcaugcuggcgcc

SEQ ID NO: 4197482 - RNA, 121 nt, Human
ggugugaggaauuggaaagcucagaaauggaaaauaguuaacguucagaguagcagaugaacacagcucucacauuugcauuuucccuuucguucugacucaucuuccccucuccccaccc

SEQ ID NO: 4197483 - RNA, 70 nt, Human
ggugugaggacuggggcuggcacggcagcaggcaugccagggcaccaugggcuggcugccuuaucacacc

SEQ ID NO: 4197484 - RNA, 117 nt, Human
ggugugauugaaagagauaaugugucugaaagugcaauguaaauuguaauacucuauauacaugucauaguuauuauuguuacuaucagcaccaucaucaucauccucuagcacauc

SEQ ID NO: 4197485 - RNA, 81 nt, Human
ggugugcaggaaguagagggcguuauacugggugaaguggguggacucuacccagagcuaugaccugauuugugacgcacc

SEQ ID NO: 4197486 - RNA, 55 nt, Human
ggugugcauggcacagggcuuguucuaacgagugugcagugagcagugcagcacc

SEQ ID NO: 4197487 - RNA, 65 nt, Human
ggugugccuggggcuuagcugcucucagggaagcugccccucugcccagugcaaguccccacacc

SEQ ID NO: 4197488 - RNA, 118 nt, Human
ggugugccuuuuaccagcccaagcuacuuagaaagcacaguuggugcaugauuuaucucccuguucaugcccaugcuuagcauugugcuuuguauuuggcuagugcugaagaaauacc

SEQ ID NO: 4197489 - RNA, 58 nt, Human
gguguggcagcagaucagacugaaaaccaagcaggugaaagucuucaucugccaggcc

SEQ ID NO: 4197490 - RNA, 60 nt, Human
ggugggucacuugaggucaggaguucaagaccagccugaccaacguggugaaaccccauc

SEQ ID NO: 4197491 - RNA, 81 nt, Human
ggugggucugugguuggcagcucaaugaaacaggagucugaggaugaagccuggugucugggcagcuucugcaugcccacc

SEQ ID NO: 4197492 - RNA, 87 nt, Human
gguggguggguagcguggggcagaauugggagagagacacagugaccgggugucccaguucccaggguugcuaacugcucacgugcc

SEQ ID NO: 4197493 - RNA, 61 nt, Human
gguggguguggguaagagggacagagccauaaagggcagcucuuccugcuccacacucccc

SEQ ID NO: 4197494 - RNA, 71 nt, Human
gguggguuaugaagggcgaaggaccucuuagcaggacacucagcugagguccagcauucgccuaauccacu

SEQ ID NO: 4197495 - RNA, 71 nt, Human
gguggucaggacauucuggcggucaggacaccuuggugacgccguucccugcugagagugcucuccccacc

SEQ ID NO: 4197496 - RNA, 69 nt, Human
gguggugaucaggucugaacagggagguccaugcacauaugaaauuucuuccucucaggcuuucccacu

SEQ ID NO: 4197497 - RNA, 83 nt, Human
gguggugccaaggugcuaagggcaugaacccucaucuuccuaggccaguuugcauguaucuuaauugcuuuggagacacuauc

SEQ ID NO: 4197498 - RNA, 58 nt, Human
gguggugcugguguucagaugcuaccucuucgguacaaauguacacuuguauaaaucc

SEQ ID NO: 4197499 - RNA, 62 nt, Human
ggugguggggagcccugggaaagcugagaggggauacaguuggcagggccuaccccaauauc

SEQ ID NO: 4197500 - RNA, 73 nt, Human
ggugguggggucguaggugcccgccagguaguagagguccugccgguccuggcacuugcggcuccgggccauc

SEQ ID NO: 4197501 - RNA, 81 nt, Human
ggugguggugccacuggcaucuaguggguugaggucagggaugcugcucagcagccuacaaugcacagaacagcccccacc

SEQ ID NO: 4197502 - RNA, 66 nt, Human
gguggugucaaacauucuagcuguucugauuuucaauuaguuucauugagauguuugcuacccacu

SEQ ID NO: 4197503 - RNA, 65 nt, Human
ggugguguguuuucuucauucugcagggauccugcuagauggagcagaauagcuaugcugccacc

SEQ ID NO: 4197504 - RNA, 55 nt, Human
ggugguucacgccuauaaucccaacacuuugggaggccgaggcagguggaucacc

SEQ ID NO: 4197505 - RNA, 55 nt, Human
ggugguucacgccuauaaucccagcacucugggaggccgaggcgggcggaucacc

SEQ ID NO: 4197506 - RNA, 55 nt, Human
ggugguucacgccuauaaucccagcacuuugggaggccaaggcagguggaucacu

SEQ ID NO: 4197507 - RNA, 55 nt, Human
ggugguucacgccuauaaucccagcacuuugggaggugggugcggguggaucacu

SEQ ID NO: 4197508 - RNA, 77 nt, Human
ggugguuccuguccauguuaagccccuugcugcagagaugugcuuguggcugggguugaagccuggcugugagcucc

SEQ ID NO: 4197509 - RNA, 60 nt, Human
ggugguucgguggaauggacugcaacgcauuagauacugcuguuauucuuccaggccacc

SEQ ID NO: 4197510 - RNA, 73 nt, Human
ggggcugccaugguugauaaaugcuugagguuugguugaugaucugaggcccaguucaacucuuggcuucccc

SEQ ID NO: 4197511 - RNA, 75 nt, Human
ggggcugcucgccgcgcguuucggagucccggauacgcggcggagagcgggacgcgcgguccacgggcaagcccc

SEQ ID NO: 4197512 - RNA, 82 nt, Human
ggggcugcuucauucuuaucucucucugcagcuuucucugcuauuuaaucugcauggaggaagaugaaugcaccacaguucc

SEQ ID NO: 4197513 - RNA, 61 nt, Human
ggggcuggcauaugcaguuguacaccaugguguuuuacaaagcacgagugccauggacccc

SEQ ID NO: 4197514 - RNA, 60 nt, Human
ggggcuggcucacuaagagacuccuggcacuguguugagucuagcauggagccagcgccc

SEQ ID NO: 4197515 - RNA, 93 nt, Human
ggggcugggggcugggcaggcccugaggagcugagcggggagggcuggaaaacaggacucuccuccaacagcccugccgcugccuccaacccc

SEQ ID NO: 4197516 - RNA, 65 nt, Human
ggggcugguguuugcugaagcuggagccaagguggccacccauccucagcucaggacucagcccc

SEQ ID NO: 4197517 - RNA, 96 nt, Human
ggggcugucagugcuaaccucagagcucuauguucauggagggaugacucaguuacauccccagauagcuggguucucgguuggucaauaggcccc

SEQ ID NO: 4197518 - RNA, 67 nt, Human
ggggcuguguccuggccaaggccuugcuugcagcaaaaggcagagcuggggucuagccaggagcccc

SEQ ID NO: 4197519 - RNA, 70 nt, Human
ggggcuuccagcgcccgccgguggccgggacccacuaaagcccccgcagccgaggagugcggggagcccc

SEQ ID NO: 4197520 - RNA, 79 nt, Human
ggggcuucccaagggcuuugggcuuuccugggcucucccaaaaggaguccuggcccaaucugcccaugaugauggcccu

SEQ ID NO: 4197521 - RNA, 62 nt, Human
ggggcuugcuuaaggucacccgguucuuaaguggcagggcuggggccggacagcaaagccuu

SEQ ID NO: 4197522 - RNA, 81 nt, Human
ggggcuuggaggcccaaugcuucccuccuucuagccaggcugggcugcagggaggggcagcagugggucaggaaaggcccc

SEQ ID NO: 4197523 - RNA, 65 nt, Human
ggggcuuggaugcucagcuuggcccuuuuuggaccuccaagauguggugggcugaguuuggcccu

SEQ ID NO: 4197524 - RNA, 61 nt, Human
ggggcuuguagcucucuuucguucuaaaagauuuuaaaacagcagaaacugcaagcuaccc

SEQ ID NO: 4197525 - RNA, 60 nt, Human
ggggcuugugucaaccuguggccggguggggaugcuccuucccagcugguaggcugcccc

SEQ ID NO: 4197526 - RNA, 61 nt, Human
ggggcuuuucaggggugcagaggccaggcuucaggugggucucugugaguggaaggcaccc

SEQ ID NO: 4197527 - RNA, 68 nt, Human
ggggcuuuugacagcugagccccaggcaagcacgacacucggccuccugguaauuagcgaaaggcccu

SEQ ID NO: 4197528 - RNA, 76 nt, Human
gggggaagcagauuucugagucaaucaaguuugauuuuauuugaauuauggaauuuuuagagaaguguuuuauccc

SEQ ID NO: 4197529 - RNA, 109 nt, Human
gggggaaggugacucaccuggagaguggaguguguguguguguguguggguguggguguacacacaugcauaagccuucccuucuucuagagugggugucccauccccc

SEQ ID NO: 4197530 - RNA, 127 nt, Human
gggggaaucccgugcugaaugcaggagugccgggguuccuggguuuucugccgauuguuccagguucaggagcugggagggagcagagaacccaaccgccacccucccguaguccacgggugccccc

SEQ ID NO: 4197531 - RNA, 55 nt, Human
gggggacaggcuaaccaggccgugugugagagcagccuuugguuucuuguccugc

SEQ ID NO: 4197532 - RNA, 130 nt, Human
gggggacaugacagagcaugugucaaggggaucagucggcuccugcucagggcucugggaccagccucaggaaggaagcagggagcccagggaagggacgauugcuuuguaaaucacagcgcucucuccc

SEQ ID NO: 4197533 - RNA, 77 nt, Human
gggggacgacacagcgugugccucgggguacacggggccauaggugaugcugugugccccggcacauucuugcccuc

SEQ ID NO: 4197534 - RNA, 129 nt, Human
gggggacugcuggugggggaugacuggcagaggaugugcaggugcagcuggauggaagcccuuggcauuggggcuccugucaugcauccaaauccccagugccccuauuccuccacccaggucauuccu

SEQ ID NO: 4197535 - RNA, 88 nt, Human
gggggagaaguuggacaguuugggaagggagaguggucugcucugccaccucaaucuuuccuuucucuggacugcagccacauccacc

SEQ ID NO: 4197536 - RNA, 56 nt, Human
gggggagacuguccaggguuggggggaaacugucuuugccuggaccugucuccuuu

SEQ ID NO: 4197537 - RNA, 98 nt, Human
gggggagagugucaggugcuugcuguaacaagcccuuggcaaguauagaaacaguuuaaguguuaaggggauauagcagggcccugacagcaucugcu

SEQ ID NO: 4197538 - RNA, 63 nt, Human
gggggaggaguucagaccagaugccaggcacugugccugcauuuucucaaugaacccucuuuc

SEQ ID NO: 4197539 - RNA, 59 nt, Human
gggggaggguggcgcaaggagaggacaccucucuccuggcccugucgccaucuucccuc

SEQ ID NO: 4197540 - RNA, 55 nt, Human
gggggauagguuuggaagagguggccauaagccauucauuagagcuuaguccucu

SEQ ID NO: 4197541 - RNA, 74 nt, Human
gggggauccgggcgcagccaauccuggcccuaggauuguguuggggggcuuggcaggcggugucccgacccccc

SEQ ID NO: 4197542 - RNA, 60 nt, Human
gggggaugugggaggagaaaaagccauuuauucuuuuuggucguuccucucacauuuuuu

SEQ ID NO: 4197543 - RNA, 60 nt, Human
gggggcaagcuauuugaccaguuccucugugguuagaggcacugaaggaagcuugcgcuu

SEQ ID NO: 4197544 - RNA, 57 nt, Human
gggggcagaauguacucuugucugaauuauuagcauuugguguugguucugccaccc

SEQ ID NO: 4197545 - RNA, 56 nt, Human
gggggcaggaauaaaggacagcuguauugauggcccaguuuucugaucuugccccc

SEQ ID NO: 4197546 - RNA, 64 nt, Human
gggggcaggagaaaaucgugucguugagcaauaaacagaagagugguccuucuuuacugccucc

SEQ ID NO: 4197547 - RNA, 55 nt, Human
gggggcaggauggagaagagagagacuugcugguccugacccaaucucugucccc

SEQ ID NO: 4197548 - RNA, 55 nt, Human
gggggcaucaucugagcucgguugucccucagcagccugggccagagcuguccuc

SEQ ID NO: 4197549 - RNA, 55 nt, Human
gggggcaugagauggagcucaccugaguggaugcgccucuccaaauccugccuuc

SEQ ID NO: 4197550 - RNA, 90 nt, Human
gggggccacagagcacacccguggagaagcaggagcgggcccugggccuccucagcuuggccacggaguugcugcccugccuugguuucc

SEQ ID NO: 4197551 - RNA, 99 nt, Human
gggggcccuccaggucgggccgggcuguggagaagggguguaagcggucacgaccccgcuccuugcagccucuggccuccuuaugucuggagggcuccc

SEQ ID NO: 4197552 - RNA, 80 nt, Human
gggggccgagaacugggacuuuguaggccaguugauccgacacccucaucucgcccgcaaagacccagcccucagcuccc

SEQ ID NO: 4197553 - RNA, 115 nt, Human
gggggccugugcagucgugauuguuaauagaauucagaauauccguuuaaguuugcuuucaaaguuaaauagaaauucuggcuuuuuaaagugucuuugaaaugaacuggcuuuc

SEQ ID NO: 4197554 - RNA, 68 nt, Human
gggggccugugcugagaaccuggcuggcugaaggagaggaaccaccgaggcugagcaugaaggccgcc

SEQ ID NO: 4197555 - RNA, 75 nt, Human
gggggcgaaaguucauuccugugaggacagcccgcuccuuggcaugucacaacagaggaacugaauucugccucc

SEQ ID NO: 4197556 - RNA, 62 nt, Human
gggggcgaugacggugaugaugagaaucccagguucaaaauaauaacgucugucuugucucu

SEQ ID NO: 4197557 - RNA, 57 nt, Human
gggggcggcuucccacggacacguuugaguucuguguucucagggauaacuuccccc

SEQ ID NO: 4197558 - RNA, 81 nt, Human
gggggcuaugggaaguguuagaagauuuuagggacagauuuugaagagucugaaucuauacugcccagugcaguagccccu

SEQ ID NO: 4197559 - RNA, 70 nt, Human
gggggcucaguccuuccuugccccuugggcugcccuucaggguuaaguagagggucccagcugagcucuc

SEQ ID NO: 4197560 - RNA, 60 nt, Human
gggggcucaguuguugucuuacagaaaaaaaccuuguaaaggcaauucagcaagccaccc

SEQ ID NO: 4197561 - RNA, 72 nt, Human
gggggcuccugcugggagcccugacuagccugggagggucccaggaacuuggcgggccccaaggaagccccu

SEQ ID NO: 4197562 - RNA, 80 nt, Human
gggggcugaaaacuggggccugaaagguucucgcccagcucuccugggccggagcggacagguccuagcagacagucccc

SEQ ID NO: 4197563 - RNA, 62 nt, Human
gggggcuggacugauggaccacaagggaauggagcccugggauaccagacaccagauucccc

SEQ ID NO: 4197564 - RNA, 88 nt, Human
gggggcuggcugcauggcacagagugcugagauguuugggacaaagauggcucuacucuggcucaccauuuucacucucugcgccccc

SEQ ID NO: 4197565 - RNA, 91 nt, Human
gggggcugugcacacaaaagguauggccucucccucugccagccacgucuguagggaaggagaccaagccacagauggaugcacaacuccc

SEQ ID NO: 4197566 - RNA, 79 nt, Human
gggggcuuggugcugaauuggagaugcuccugcccuuuggucaccugaugcaggugcuuuccucagaucuaccucccuc

SEQ ID NO: 4197567 - RNA, 118 nt, Human
ggggggaaagauuugcaaagugugagggguaaauuuaaauuuucugauggagagcucuuucaguugcuaauagaagauuugggaaaauguuaucccucaaagaaaaaaaauucccuuu

SEQ ID NO: 4197568 - RNA, 109 nt, Human
ggggggcaaggagcuaaugacugcaccuugggaagcgccaguuggguaauuaauucacaguucugagcuuucccagaaggaaaaagauaaauuguucacuugcacuccc

SEQ ID NO: 4197569 - RNA, 103 nt, Human
ggggggcugcagcucagauuuuguuuccuuucuauacaggaugccauauggcacgcugucccuggggagaggacugacagugcuguaguugccacuuaccccc

SEQ ID NO: 4197570 - RNA, 98 nt, Human
ggggggggauugagaggggaagauuauacuuuugaauaucucaauauuugauaauuuuuaauaguauuuuuuccaggcucagaauaaugucccuucuc

SEQ ID NO: 4197571 - RNA, 79 nt, Human
ggggggucggggggaggaauggaggcuucuggggguugcucuggaccaggaagccuuuuucuuugacccuuguccccuc

SEQ ID NO: 4197572 - RNA, 71 nt, Human
ggugaauggucaaguuaacugccucucagcccuucugucucagaggcugugaagguuaaagacgaugcauc

SEQ ID NO: 4197573 - RNA, 55 nt, Human
ggugacaggaacauaaauguaggagugauguauuaugucuacauggguccuggcc

SEQ ID NO: 4197574 - RNA, 102 nt, Human
ggugaccaacuauccugguugguccaggacuugugauuccugggacauugaucuuuaaugcugagcugggacaguccuggguagacaggauggcugaucacc

SEQ ID NO: 4197575 - RNA, 87 nt, Human
ggugacccgcacgugcagagccccuggguugggagcuggcagaagcacagcaccagagcuaugggccugcagaguucgggggaagcc

SEQ ID NO: 4197576 - RNA, 66 nt, Human
ggugacccuggaacacaucucgcugcagggcaaauguccuuggggugucauguuccucugguuucc

SEQ ID NO: 4197577 - RNA, 66 nt, Human
ggugaccucccguggccugagguguucauacguggagugguggacaccgcagccaugaaagggacu

SEQ ID NO: 4197578 - RNA, 60 nt, Human
ggugaccugggucccagccccuggccccaaggauggggcauggggcucugauccuucacc

SEQ ID NO: 4197579 - RNA, 111 nt, Human
ggugacggccaccucugcccaucugccccucgacgcaaugaaggggacggccaccucugcccauccgccccucgaugcaaugagggggaaggucaccacugcccauucgcc

SEQ ID NO: 4197580 - RNA, 62 nt, Human
ggugacuaaugugucccaguuuucucaucaaauucccaggaaauuugggacgauuggccacc

SEQ ID NO: 4197581 - RNA, 84 nt, Human
ggugacugauuuugacucugcuaggaaaaucucaggauggaaauuuccugagcugacaguaggucaugcugaauuagagacauc

SEQ ID NO: 4197582 - RNA, 55 nt, Human
ggugacugcauuccccaggugcaaucuuucagcaugugaccugauguaguacauu

SEQ ID NO: 4197583 - RNA, 83 nt, Human
ggggugaacccggcgggcacucagggucgaggugggggccaucacucccuugagcccugaggucccuacuggagggucacccc

SEQ ID NO: 4197584 - RNA, 74 nt, Human
ggggugacucccagcuccugggccccacagagaguccauguucucagugcaguggcugagcuggaggacgcccu

SEQ ID NO: 4197585 - RNA, 90 nt, Human
ggggugcacgcagccucagggacuccaugcugcagcuccuccgcggaggaaccacugaacggggaauccuaugaaagcugcugucccacc

SEQ ID NO: 4197586 - RNA, 90 nt, Human
ggggugcaguaugcagagcuaggccaucucugucguccuacaagaaccaggcagcccugagcaaggcuuuuaacaugcaagguguacucc

SEQ ID NO: 4197587 - RNA, 61 nt, Human
ggggugcuuuggucagcaauauuguggggaguuacuccagaccacccuggccaugcacccc

SEQ ID NO: 4197588 - RNA, 74 nt, Human
gggguggaaggcagcagucucaggcugauuggucuguccaggaagcagcuuuucucugagaccuuuccacaccc

SEQ ID NO: 4197589 - RNA, 58 nt, Human
gggguggaggcaguuaaauuuucaccuguauaggaaauaagucugucugcuuucccuc

SEQ ID NO: 4197590 - RNA, 68 nt, Human
gggguggggaacacuguguaagggcagggguagcaacuuuccuccaggauaccuguuccuauaucccc

SEQ ID NO: 4197591 - RNA, 108 nt, Human
gggguggggaggcugagaguggcucccaaaaucccuccccaggcaaguccuggauacaagccaggccagccucaggcagggaccgcacacucaggccucucucacccc

SEQ ID NO: 4197592 - RNA, 67 nt, Human
gggguggggccugcuccagcggccacggggaggggccgggggucgcuagaaggaggccgaccagccc

SEQ ID NO: 4197593 - RNA, 70 nt, Human
gggguggggcuggccuggggugagggcuggagggcuccgcugcagcucccugguagccaugcucuccccc

SEQ ID NO: 4197594 - RNA, 68 nt, Human
ggggugggucccuucuugcuaugcucagaggucuaggcucucuggcuuggcacggagaugcccagccc

SEQ ID NO: 4197595 - RNA, 55 nt, Human
ggggugguggacucagcaucaugggcaguauagcucccagccucucuuccacccc

SEQ ID NO: 4197596 - RNA, 90 nt, Human
ggggugguggcggaggcuccaggaagcccagccuccucccucacucacaccugcggucgccaaaccuggggcuuaugccauugccgcccc

SEQ ID NO: 4197597 - RNA, 60 nt, Human
gggguguggcuggcaacccauugucaccguguaaguacaguauaacuccaugccacccuu

SEQ ID NO: 4197598 - RNA, 83 nt, Human
gggguguugucuuucuugguauaaagcagggauauccaaucuuuugacuucccugccuauauuaaaagaagcaaaguugucuu

SEQ ID NO: 4197599 - RNA, 78 nt, Human
gggguuaagaaacuugccugaagucaaccagcuauuaaugagcagagcugggauuucaagcuaagugaauuugauuuc

SEQ ID NO: 4197600 - RNA, 80 nt, Human
gggguuaagacuacauuucucaguaccugaauuggcuuaauucuuggauuaaauggaauaaucaguaguucuuaacaccc

SEQ ID NO: 4197601 - RNA, 125 nt, Human
gggguuagaaaugaugcuucagaggugaggucaaggaugaggaaugggagauggaggcacgaaaaccuuacucugccuguaccucuuuuuugcagaaggcagcugagggcaugguaaugagcccc

SEQ ID NO: 4197602 - RNA, 67 nt, Human
gggguuaucaauuacuuacauagccuuccucuaagggaaggcuugcaagugguucauauucgacccu

SEQ ID NO: 4197603 - RNA, 74 nt, Human
gggguucacuaaggucuuuaacaggucuuuuucuaauuauagccaagaagagccuggggaccauggccgacuuc

SEQ ID NO: 4197604 - RNA, 74 nt, Human
gggguucagggggcuuuccuggaaagagggcuagcauugagcuuuagccagucuccuaagagccccugagcccc

SEQ ID NO: 4197605 - RNA, 83 nt, Human
gggguuccugcacccggggccccugaacccgagacuccugcacccgcagcuccugcaccaggggccccugcacccgggacgcc

SEQ ID NO: 4197606 - RNA, 73 nt, Human
gggguuccuuucuacagaugccucuugcccaggcugggcauguuuaaucugcauggagcuuaaagguaacccu

SEQ ID NO: 4197607 - RNA, 59 nt, Human
gggguuugagcugcaguggaggauaccaaagcaccggucuucugagaguucacagcccc

SEQ ID NO: 4197608 - RNA, 63 nt, Human
gggguuugcagcaauggagggcagugcaaaaacaaugccugucaccucuuuggcugcagcucc

SEQ ID NO: 4197609 - RNA, 108 nt, Human
gggguuugggaaauggaaguugcacccuucaccuugccugaagacuauuccuccaggcugggcugaagggugcuuacuuucuuuaucugcacacauuucuugaguacc

SEQ ID NO: 4197610 - RNA, 66 nt, Human
gggguuugggauuuguucacaguaauuuuucugcucugaguccauaguggauccuucaaaaacccu

SEQ ID NO: 4197611 - RNA, 58 nt, Human
ggguaaacaccuguuaaauucagaacauugcaaguuaucugggugcuaguguuugcuu

SEQ ID NO: 4197612 - RNA, 71 nt, Human
ggguaaaggauguguguacaaggaaaggagaagaccauuuccuucucuguaccucacaugcaccauccccu

SEQ ID NO: 4197613 - RNA, 67 nt, Human
ggguaaauguucugauguaggguuuagaaaucaggauuauugucacccuaaccaaacacccuuaccc

SEQ ID NO: 4197614 - RNA, 68 nt, Human
ggguaacagggagguugaagguauuggaguugagagacccaggcugugcaaacuucaaaugauuaccc

SEQ ID NO: 4197615 - RNA, 92 nt, Human
ggguaacaguggauaagaaaugcuacacaagcuccuuauguggagaaaagacuguucuccuauuuggaagccuugugcccauauccaugccc

SEQ ID NO: 4197616 - RNA, 65 nt, Human
ggguaagaacaagcuggggguuccacuagcaugggcugugagaauagaaagagcugucauuaccu

SEQ ID NO: 4197617 - RNA, 111 nt, Human
ggguaagagaugugagcuuuguaccaaaaaagaacuaauucugacuuuuuccacaauuuuaaacaaaagccaggauaaaguuguuuuaaaguuuaaaggguacaauuaccu

SEQ ID NO: 4197618 - RNA, 82 nt, Human
ggguaagaggaagaaauugaauucaugagcuuaaggcaugagcaaugaagccaggagcugaacaauaucuuacuucauaccc

SEQ ID NO: 4197619 - RNA, 71 nt, Human
ggguaaggaggcgagguggugagcagcugagccauguuaacagccuugcuugcccaucucccuccuucacu

SEQ ID NO: 4197620 - RNA, 86 nt, Human
ggguaagugggagucaaauauuccagcuucuuugucccuggguugaacaauucagaggucccuagcaggagugaaccccauugccc

SEQ ID NO: 4197621 - RNA, 65 nt, Human
ggguacaaggagugaagguuuggaaaggggagcagguuuccaaagagucaagccucccucuuccc

SEQ ID NO: 4197622 - RNA, 68 nt, Human
ggguacaagugcacaacaugcagguuuguuacauauguauacaugugccauguuggugugcugcaccc

SEQ ID NO: 4197623 - RNA, 93 nt, Human
ggguacaauauauuucuagcaaccuauggauagagaagagaacauauauucauuuauuuucucaucauuggguugcaaguaugugcuaggccc

SEQ ID NO: 4197624 - RNA, 88 nt, Human
guaaggauucuuacauagagaaguuacaguggaagauaauucacauugauucauugucugcuuugguucacuaugauagggaccuuau

SEQ ID NO: 4197625 - RNA, 80 nt, Human
guaaggguucacuggaacuaagggggcuccagcuaaaaaacaaguuugaaaggcacugaucuuauccaguaucaucuuac

SEQ ID NO: 4197626 - RNA, 57 nt, Human
guaaguaauuuuugagagggugcucuuaaucucuauccucaucaaacuuucacuugc

SEQ ID NO: 4197627 - RNA, 66 nt, Human
guaagugaauagaagcuuuuaaauaacaggagagagaaaaagcugucccaaagccuauacacuuac

SEQ ID NO: 4197628 - RNA, 90 nt, Human
guaagugugugguauaauuucugguacauaguaagaacacaauuaaugcuaguuguuuuuaguagugcuauuacuacuacuacuacuuau

SEQ ID NO: 4197629 - RNA, 62 nt, Human
guaaguuuuccugaaacugaugguguuauuaggcaugaccucgucagacuuagaaaaccugc

SEQ ID NO: 4197630 - RNA, 65 nt, Human
guaauaauacuagucagccuuguucaccaauuccuaugugccaggugcugagcuaguguugccac

SEQ ID NO: 4197631 - RNA, 67 nt, Human
guaauaauuugcuaccuggugggauauugugagguugagugaaucaucagugcuugcaaauuauuau

SEQ ID NO: 4197632 - RNA, 80 nt, Human
guaauacacuacuguagugaugauaauuaaguggcaaauucuacacaguugauugucacucagggaauuagugcuguugc

SEQ ID NO: 4197633 - RNA, 76 nt, Human
guaauacuuuaagacugucugggacaagaugagauggugguuauugcuguuguauaauaguuuugagguuugauac

SEQ ID NO: 4197634 - RNA, 74 nt, Human
guaauaguuuuagcaaaggugucuugggcauauuaucaagaugcuauuagaagccaugcuguuuucauuguuau

SEQ ID NO: 4197635 - RNA, 87 nt, Human
guaauaucauuguaaucauaucuauuuuguaaagguccccuuuguagagaauaaaacaaauuagguguguguuacagguugaauuau

SEQ ID NO: 4197636 - RNA, 59 nt, Human
guaauauccugaacaguugacuguacaaugacuguacagugacagauagggauagaaac

SEQ ID NO: 4197637 - RNA, 64 nt, Human
guaaucccagcuacucgggagacugaggcaggagaauugcuugagccugggaggcggagguugc

SEQ ID NO: 4197638 - RNA, 64 nt, Human
guaaucccagcuacucgggaggcuuaggcaggagaaucgcuuaaacccaggaggcggagguugc

SEQ ID NO: 4197639 - RNA, 63 nt, Human
guaauccuguguguguauguguaaaaaugugucuauacauuuguauauaugcagcauacuuac

SEQ ID NO: 4197640 - RNA, 84 nt, Human
guaaucgggcaucacagcaguucaggccgcagagggcuccaggcucuuuaccuuuuacaagcugugugaccuugggcagauuac

SEQ ID NO: 4197641 - RNA, 64 nt, Human
guaaucucagcuacuugggaggcugaggcagaagaauugcuugaacccaggaagcggagguugc

SEQ ID NO: 4197642 - RNA, 64 nt, Human
guaaucucugcuacuugggaggcugaggcaggagaauugcuugaacccaggaaguggaggcugc

SEQ ID NO: 4197643 - RNA, 89 nt, Human
guaaucugaauauaccugaucaaggcaaaaauguaaguguggucauuaugaguauuucauuauuguuuuuaucagggaaaugagauuau

SEQ ID NO: 4197644 - RNA, 68 nt, Human
guaaugaacaaucuggcaagaacuugaaaaccugacaggcuuaaagguuacaugccagagugcucugc

SEQ ID NO: 4197645 - RNA, 62 nt, Human
guaaugaauggugucuaaagaagguugccucauugugagguaaguuagagcacaauucuuac

SEQ ID NO: 4197646 - RNA, 55 nt, Human
guaaugacaauagacuauccacagcuaccuuuguggaaccuaaaaaugucauugc

SEQ ID NO: 4197647 - RNA, 86 nt, Human
guaaugagugguaguaucuucaauuuauucaaggagaguuuuguugaaugauuuucuuugacauucauugaauauccacucccugc

SEQ ID NO: 4197648 - RNA, 68 nt, Human
guaaugaugaugaugaugggccuugcugagacauagugcagcucuuuaaaccauuucaugauuauuac

SEQ ID NO: 4197649 - RNA, 91 nt, Human
guaaugcgcaugaauuauaaugagaucuuguugauguuauauauuaugauacaacagaaaaugauuauucuuugugauuaccuuauauuac

SEQ ID NO: 4197650 - RNA, 85 nt, Human
guaauggcaauggauuaagcaaaacuucauuugacaaaaauauuuccagguccugaagagguugucuuuauauguuugcuauuau

SEQ ID NO: 4197651 - RNA, 63 nt, Human
guaauggggguugaugagggagggacagugaaaacaacuguaaaaccaaaucaaucuaguuau

SEQ ID NO: 4197652 - RNA, 60 nt, Human
guaauguauuccuuuuucuuucuguucugucuuggguggagaggaagaagaguguauuau

SEQ ID NO: 4197653 - RNA, 110 nt, Human
guaaugugaagccaaggguagagagacugggcuaaguauuaauaauuauuguaaaagugacauuuauuagaugcuuacuacaugccaggacucugcugacauuuacaugc

SEQ ID NO: 4197654 - RNA, 76 nt, Human
guaauguguuaacaugacaauuggcuuaucauaaaaaguuaugaaagcaggaauuguucuguuuuacacaugauac

SEQ ID NO: 4197655 - RNA, 126 nt, Human
guaauuaauacuaacugggauuguuaguacacugcucuguacagggauacuguuacaaauuacaaacaucaguagacagauuucuuguuagacauuguugccuucacagcuaagaguauuaaauac

SEQ ID NO: 4197656 - RNA, 63 nt, Human
guaauuacagguccaaaacaaucucauaguuuuauuuggggguuauuugcauccuguaauuau

SEQ ID NO: 4197657 - RNA, 57 nt, Human
guauugcauuuugaaugcaugguauugauugccagagaaucaguuaaauugcaguau

SEQ ID NO: 4197658 - RNA, 62 nt, Human
guauugcuggguucccgguauguuacucucaucguguacauaucuguuagacacagcaguau

SEQ ID NO: 4197659 - RNA, 80 nt, Human
guauuggaggaaugaauagaguuuuauggaguccaguggagaaaucacagucugcauaugaccuguagugauuccaauac

SEQ ID NO: 4197660 - RNA, 88 nt, Human
guauuggaguguaagagacaaguguggugagagcagucuggcagggcuacuacuguuaugauuuacacagucccuuucauccagcuac

SEQ ID NO: 4197661 - RNA, 66 nt, Human
guauugggggugguggcugggggguggugucuuaugacauuaucucuaggcugccacuuaaaguau

SEQ ID NO: 4197662 - RNA, 100 nt, Human
guauugggguaggaggaaugauuggcaaaggaaaugauuuaagaaacacaauggcaauuucuuagcaaauuuucuuugccucugucuguuauauaauuac

SEQ ID NO: 4197663 - RNA, 81 nt, Human
guauugucauugagaugggcuuuauguucagccuuguaaaccuagcaaggucuggauuuguugcccuucagggaauaauac

SEQ ID NO: 4197664 - RNA, 69 nt, Human
guauuuaauucugugcuucuagguguuucgaauacugaauagagcuuggcacuagaaggcauuaaauau

SEQ ID NO: 4197665 - RNA, 120 nt, Human
guauuuacucagcauuacauuccauuaugguggcaaaagguuaaauacuaucaagugguuugauauuuuaguauuuaaucacuuuugucuugaacgagugaauguuuaguccguagauau

SEQ ID NO: 4197666 - RNA, 60 nt, Human
guauuuacuguuuuauauuguccagguaagaaaccuggagcuuauugggagcagaauuac

SEQ ID NO: 4197667 - RNA, 90 nt, Human
guauuucauucauucguucauucuacagagagugcauacucugugccaagcucugugcuagaacuaagaauauagacaugaacaagauac

SEQ ID NO: 4197668 - RNA, 55 nt, Human
guauuuccacccucaguaaggaauggaaaccugucccgucuggggugugaagugc

SEQ ID NO: 4197669 - RNA, 55 nt, Human
guauuuccauuagugugugcaccuugggcagccugcuggcaccauguggaaguac

SEQ ID NO: 4197670 - RNA, 61 nt, Human
guauuucccccagacucccuggcaaaaugaaaguuagcuggguugggcuugugggaaauac

SEQ ID NO: 4197671 - RNA, 57 nt, Human
guauuuccuggaaugacuagugggugggauaagccuaaaaggauuuccaagaaauac

SEQ ID NO: 4197672 - RNA, 57 nt, Human
guauuucuuggaaauccuuuuaggcuuaucccacccacuagucauuccaggaaauac

SEQ ID NO: 4197673 - RNA, 65 nt, Human
guauuugcaaaucuaaaagagaaccagucgguuuguaucaguucuuuuggguucauugcaguuac

SEQ ID NO: 4197674 - RNA, 59 nt, Human
guauuuggucacuggaguguguggaugagagauuauguugcacuucaguggcuaaauuc

SEQ ID NO: 4197675 - RNA, 64 nt, Human
guauuuuaggaagaguugaguaaauuuaaggauguacuuaauuugcucauuuuccuacuagugu

SEQ ID NO: 4197676 - RNA, 57 nt, Human
guauuuuauggcaugcaguggcaucuugacuaauugugacuaauugugauaaagugc

SEQ ID NO: 4197677 - RNA, 128 nt, Human
guauuuucuguagcuuuguugggauaaagggucuuaaccugccuaagaagauugcaugcuucuggaaggcagggcucauuucuuaggcuccuuuauugccuccacagagguuaacacagagaugauac

SEQ ID NO: 4197678 - RNA, 64 nt, Human
guauuuugagaucagucucgcaguaagauucauguugcucugugaaaucugaacucaaagaugc

SEQ ID NO: 4197679 - RNA, 66 nt, Human
guauuuugcagagccugugauugagggaaaccaaugcucccucuuaaaauuaccuuugcaaaauau

SEQ ID NO: 4197680 - RNA, 90 nt, Human
guauuuugucuacaguuuauaguuguuaugugugagaguguccuucuuauuacauuaugcguaacauuuauuuaaccagaucucuauuac

SEQ ID NO: 4197681 - RNA, 87 nt, Human
guauuuuuaaaauguguuucuguaugguuugugcccauucuuggcguggcuguggcuguacagagaccauuguucuuugaggaauau

SEQ ID NO: 4197682 - RNA, 62 nt, Human
gucaaacuguuuggaacucuuccacauaccagaaauguugaaguuuucuaaaucagaaugau

SEQ ID NO: 4197683 - RNA, 100 nt, Human
gucaaaggauugaguuugacaaggaagauuuacgcugaaguuuaguuaagcuuuagaacagauauuguaacuuuucuaugaaaaacuaauguacacugac

SEQ ID NO: 4197684 - RNA, 77 nt, Human
gucaaaggcccuuuauuacacugaaagaauugcgugacucuguucugcauuuucuuacauguggaauuaaggcugac

SEQ ID NO: 4197685 - RNA, 60 nt, Human
gucaaaggugacaccauucuuuaaaucacucagaccucagaguuugaaguuaucuuugac

SEQ ID NO: 4197686 - RNA, 86 nt, Human
gucaaauggacagagaucauuuaggccugagauuuaggcaaaggcacugcauagaaaguucuagaagacuuuuccauuuuuguggc

SEQ ID NO: 4197687 - RNA, 78 nt, Human
gucaaauuaggcaacuguuugguugaaguaugaacaaguuaaaaaucauguaaagacuauaaaguuguucugauuuac

SEQ ID NO: 4197688 - RNA, 72 nt, Human
gucaacaucagagcucccagcauggaggucucuggcauggcuggacuuacuugcugaggacuggugcuuggc

SEQ ID NO: 4197689 - RNA, 56 nt, Human
gucaacaucggaaagcguguaaaccguucuagcguguugcugugguuggugcugac

SEQ ID NO: 4197690 - RNA, 85 nt, Human
gucaaccagcagauaccgggucagcuucagaggaacuuacauuagcugugccauuuccuuuggagcuugacugguagucauugac

SEQ ID NO: 4197691 - RNA, 59 nt, Human
gucaaccugucacucugaggagagaauucuuuuuauuuccagagucuucgacgguaggc

SEQ ID NO: 4197692 - RNA, 63 nt, Human
gucaacuacagcugccaucuuugccaucucaggcagccuacaggugggggcuguguccuugac

SEQ ID NO: 4197693 - RNA, 79 nt, Human
gucaacugauggagugauggagaaauucugguuucaacauagagaugguaaauaucuccauucuccaacuuagugagac

SEQ ID NO: 4197694 - RNA, 79 nt, Human
gucaagacauuuguaggacagaggaagagaagaaagugucacauuguauuguuucuuuccuguugccugagaugaagau

SEQ ID NO: 4197695 - RNA, 66 nt, Human
gucaagagguuucuuaggggcuuccucuuguaugagguaagagguaagccuggaggcuucuauggc

SEQ ID NO: 4197696 - RNA, 90 nt, Human
gucaagaucggaaugucuggguugggagugauagacugaccagguuaccugcucaucacauguguagucaucccaaucucuguucauggc

SEQ ID NO: 4197697 - RNA, 95 nt, Human
gucaagcauuagauucucauaaggaacgcacaaccuagucccucacaugugcaguucacaauaggguuugugcuccuaugagaaucuaauguggc

SEQ ID NO: 4197698 - RNA, 69 nt, Human
gucaagccagucagcucaguagaugucccaauuaauacacucaaugaucaugcugacaauggcaaugac

SEQ ID NO: 4197699 - RNA, 86 nt, Human
gucaagccugggcuggggaugugagugcuggucgcauuguucuauaagggucacaaggcacauuccuuguccaugaggagcuugac

SEQ ID NO: 4197700 - RNA, 63 nt, Human
gucaaggggaggacacagggccaugaaggugaggggacgauggcccucaguccuuccuuggau

SEQ ID NO: 4197701 - RNA, 60 nt, Human
gucaagugcuacauuggugcuacagauucagacugugcacacaagcaaugcacuuaaggc

SEQ ID NO: 4197702 - RNA, 65 nt, Human
gucaaguucuggguucuggguuauuggggugacugcccucaaacuccuaaucacccaucuuugau

SEQ ID NO: 4197703 - RNA, 67 nt, Human
gucaaucacgccaggaggaaaaauaguggcaugauuuguuaucuguuauuccccuugcuguggugac

SEQ ID NO: 4197704 - RNA, 89 nt, Human
gucaaucauggauaagaauccgauucguguacauuaauuucuuuuacgaaagaugugcaacuugauuugaaucugaaaacaugacugac

SEQ ID NO: 4197705 - RNA, 91 nt, Human
gucaaugauagucaagaaaagguacguauucuguguuauuuuucacuuuauaaaaguagaauaauuggauuacaguuuagacuacauuggc

SEQ ID NO: 4197706 - RNA, 81 nt, Human
gucaaugccugcuuucagaccuggaugugggggccugcugggugccagcccccugcuaggcucugggaauaggacaauggc

SEQ ID NO: 4197707 - RNA, 73 nt, Human
gucaauguaaauauuuucuaaucaacaauuauguccugcaucccgaaugauuacggaagauauucccguggau

SEQ ID NO: 4197708 - RNA, 68 nt, Human
gucaaugucuuuugauacaaguuacagcagagagcagcugcaugaagacuuaaaaaagcaacauugau

SEQ ID NO: 4197709 - RNA, 111 nt, Human
gucaauuuacaguaauaauugaaagcacaaagaacaaguuuuugcuuaauuacuaugugacagacuguauuuuguacuuucguguauaugugauacuguagugcuuuugac

SEQ ID NO: 4197710 - RNA, 73 nt, Human
gucacaaagucaaggcauuucgcuuagagagaaaucugagauuucuguuagcaaaauucuuugaucaaaugac

SEQ ID NO: 4197711 - RNA, 63 nt, Human
gucacaauguuugaguaggagcauaagauuaaaaauauuuuauuagcuuuuagauuuugugac

SEQ ID NO: 4197712 - RNA, 68 nt, Human
gucacacaauaguaagugguccaagauucuaaccucagaucugcuaaccacuguacuauuugaguggc

SEQ ID NO: 4197713 - RNA, 82 nt, Human
guaucagaucaaguaguguuuuuuaugcugaaaaagagcuuacuaguagcuaauguuucugaagauacagcuuugcugauau

SEQ ID NO: 4197714 - RNA, 64 nt, Human
guaucaucuccuagcgugcaucccagccuggagcuggguccacggaagacuuagggggcuuuac

SEQ ID NO: 4197715 - RNA, 88 nt, Human
guaucauuaaaucaccauugccuagaaaaauuccugguacucagccagguuuuuaauccucuggaagcacugacauuuaagugauuac

SEQ ID NO: 4197716 - RNA, 77 nt, Human
guaucauuccugggcaaaaguaucugugagccaggugugccuccacuguaucgcuuguccuucugcuaggaggaugc

SEQ ID NO: 4197717 - RNA, 83 nt, Human
guauccaaggaucuccauugcaauauuuaaugucuugcuuaugaaaguaagaaagauaagguuugcuuggacaucuucaguau

SEQ ID NO: 4197718 - RNA, 55 nt, Human
guauccauguguucgcaucauuuagcuuccacuuuuaagugagaacaugugguau

SEQ ID NO: 4197719 - RNA, 80 nt, Human
guauccuacuuaaauggaaguguauuuaguguucuguuauuaagaauaaugugagcuuugguuuguagucaguaguauau

SEQ ID NO: 4197720 - RNA, 95 nt, Human
guaucuacuaguuucugguauuggggaugugguugagugaagcacacugugucccacugacuucacauccagacacacacaaaugggugagauac

SEQ ID NO: 4197721 - RNA, 70 nt, Human
guaucuagucaaugcuguucaaccaaccagaagcauuuuaaaagagguaggguaacaauuugcuaggugc

SEQ ID NO: 4197722 - RNA, 103 nt, Human
guaucucugccacccacggaguucuaaugacuuuaaaauaugcuaguaaugaggaaagacauaugggauauuauguagagcugagguaggugguaagagauac

SEQ ID NO: 4197723 - RNA, 106 nt, Human
guaucuguacuaguuaacugcucaguuaagcagaggaaauggugaggcuacucuauuucuuuuaaauaacuuugcauuguuacauuugaauccugguauucauuau

SEQ ID NO: 4197724 - RNA, 115 nt, Human
guaucuguucugaucaagugguacuucacuaugcucauuguuaauauuuugaacaacuugguuugggaugcugauauagagcauucuggcucuuggugcagaacauaaaugaugc

SEQ ID NO: 4197725 - RNA, 86 nt, Human
guaucuuuucugcccaggcugaaggaacauccacagauacagauguggcauguuuauuauccuugccuggagcuucuaagucgugc

SEQ ID NO: 4197726 - RNA, 73 nt, Human
guaugacucagcaugaguauugaacuugccugucuucacagaacacauggcucagucucaugacagguuauac

SEQ ID NO: 4197727 - RNA, 86 nt, Human
guaugagguuggugcaaaaguaaucgcaguuuuugccauugaagguaauggcaaaaaccgcaauaacuucugcaccaaucuaauac

SEQ ID NO: 4197728 - RNA, 61 nt, Human
guaugauguguagauacacacacauauauauucagauauguguguguaugcacacacaugc

SEQ ID NO: 4197729 - RNA, 61 nt, Human
guauggaaaucaucugaguaauaaucuggaauucacagguuccaaaugaugguuuucauac

SEQ ID NO: 4197730 - RNA, 60 nt, Human
guauggaugugugaacugguuaguuugggauccuuugcuuguuauucaccacaaccguac

SEQ ID NO: 4197731 - RNA, 72 nt, Human
gucagauuggaacuuguaaauccuucuuuuuuaagacaagcccuaagaaggaacacaaugcuucugugugau

SEQ ID NO: 4197732 - RNA, 79 nt, Human
gucagcagaugggcuuugguuuugaacuacaauaucagaucuuccuugguucuccagccuauuggccuauccugcagac

SEQ ID NO: 4197733 - RNA, 81 nt, Human
gucagcaggggccguuggguggaggaagccggcaggaugcaggcgucccuccaucucagcugcccguuguguagaacuggc

SEQ ID NO: 4197734 - RNA, 56 nt, Human
gucagcagugucagcucuggggguucugcacaaacacugcuaggguugcugcugau

SEQ ID NO: 4197735 - RNA, 119 nt, Human
gucagcccuguaacccugcauucgucaguaggaaaaugcuuugauggggcuggcuuuuuucuucuagcuauaguacuuggcuuuucuauugagugaauuaagggacacuaaggggugau

SEQ ID NO: 4197736 - RNA, 75 nt, Human
gucagccuaucugugcugauucagcacaggccucucuacgcugcaguccugagcccucagcacagcauggcucac

SEQ ID NO: 4197737 - RNA, 58 nt, Human
gucagccuggugaagccccucaugcuggucacagacugugcccggggcuccaccugau

SEQ ID NO: 4197738 - RNA, 59 nt, Human
gucagcuacugcagggaacuuucagucucacaucgcuaucucuguccuguagagcuggc

SEQ ID NO: 4197739 - RNA, 86 nt, Human
gucagcuaucagaagucuucagacuggagagauuccuggagggggaguggcccuuuaauccaucagcugaagccaucugguaggac

SEQ ID NO: 4197740 - RNA, 77 nt, Human
gucagcuggcccacuccuauuaaccaugccuucaucuguaguggaaggaacauggcucacaggaugggcuagcaggc

SEQ ID NO: 4197741 - RNA, 67 nt, Human
gucagcuuuucuccuuagugucccuguaucccgucuggagcccagaggcaaggaugaagaugccaac

SEQ ID NO: 4197742 - RNA, 60 nt, Human
gucaggaagcaagguugggcauuuguagacaaucaguagcccacccuccaauucuaugac

SEQ ID NO: 4197743 - RNA, 81 nt, Human
gucaggaaggauggcaaaggcagcaccgccuccugaaacaauagagucaucaggcacguugcugcccccgucuaauuugau

SEQ ID NO: 4197744 - RNA, 67 nt, Human
gucaggaaugcucuggaaaaacauccugcauuuggaaggaaauuggaccacaugagcucuuucugac

SEQ ID NO: 4197745 - RNA, 82 nt, Human
gucaggacagcccugcaugcagcaggcggccacuugcaggcccagaagggcuuccugggguccaccugagcagcagccuggc

SEQ ID NO: 4197746 - RNA, 81 nt, Human
gucaggaccaaugaguuccauguguccucaggaaacccugaaggacagcauaugggaaccaguuugauauuuggccuugac

SEQ ID NO: 4197747 - RNA, 60 nt, Human
gucaggagauagggcaagcuucaggaauaguuaagacccagaggguuaucuauccuugac

SEQ ID NO: 4197748 - RNA, 63 nt, Human
gucaggaggcgucucgcuggggcaagagggagcuugcucuuaggcagagggcgucuuugugac

SEQ ID NO: 4197749 - RNA, 79 nt, Human
gucaggcaccuuuggaaacugccucagcucuuccuucuggggguggcaggaggggaaguuuaugguaaagguguaugau

SEQ ID NO: 4197750 - RNA, 58 nt, Human
gucaggcagccuggagauucagggaaaaguuauaguccaacuccaaaugcagucuggc

SEQ ID NO: 4197751 - RNA, 59 nt, Human
gucaggccuggagaaaggaaugacaucuugaugaaacucagcuuucucagaggccuaac

SEQ ID NO: 4197752 - RNA, 126 nt, Human
gucagggagcagcugggcuuggcgccuggaacuuagggucucugagccuccgguguccauggagacugagaggaaauugagacuaucuaugggcucuggggccagggaaggugcucccucagggac

SEQ ID NO: 4197753 - RNA, 58 nt, Human
gucagggcaucucuuaagugguggguaugugccuacagcagagugggaugcaucuggc

SEQ ID NO: 4197754 - RNA, 68 nt, Human
gucaggguugugaaggaaaggggguuaagauugcgguuuaucucauugcuugguuucacaaccuugac

SEQ ID NO: 4197755 - RNA, 68 nt, Human
gucagguuuugcaaaugagcuaaugaauaugcucuuuugcauuucuuuuccuccucuuguuggccugc

SEQ ID NO: 4197756 - RNA, 56 nt, Human
gucaguaaugaauuauaaagcacuaaaaaaauaggcauuuguaaguccuuacugau

SEQ ID NO: 4197757 - RNA, 81 nt, Human
gucaguagugcagaggcugggaaaugcugggacaugcacaagugagccccaugagcacuucuguggccucugcacagagac

SEQ ID NO: 4197758 - RNA, 71 nt, Human
gucaguauugaacuuucaguuaaagcaaccuguuuuucacacaggcagcuuuaacugguaguagaaauggc

SEQ ID NO: 4197759 - RNA, 95 nt, Human
gucagucccucaucuaugcgguugugcaucugggauacuuuauuuuugaugagcauuugguugcagauguggaacucgugccuaugggggagggc

SEQ ID NO: 4197760 - RNA, 75 nt, Human
gucagugcuguggaggcagucagugugguucauaaagcaagcauuguuaaugggccugacucugacagcaguggc

SEQ ID NO: 4197761 - RNA, 58 nt, Human
gucagugggugaaagauggcuaagucugaagcuuguucauguugucguccuaugagac

SEQ ID NO: 4197762 - RNA, 84 nt, Human
gucagugugcaagauggguauuuaugaagcagaauauuuagaguaacugguucagcuuacaaaauacaccuauuaaaauaugac

SEQ ID NO: 4197763 - RNA, 79 nt, Human
gucauagaaacuuggacaugcagcugggugaaauaaguuccauucagcauucauuuccaacuucagccaaucucaugac

SEQ ID NO: 4197764 - RNA, 79 nt, Human
gucauagaguccaguaaaauuugaaacuguccaauuauaucagaaaguucuucauuuuuauuggaaauaaaacuaugac

SEQ ID NO: 4197765 - RNA, 66 nt, Human
gucauagauuucaucugauuugaucccucuuucuucagaugagggcgcuucagagagaugaaugac

SEQ ID NO: 4197766 - RNA, 61 nt, Human
gucagcuguacugugccauagcucacagccacauugugauuugggggagcguauaguuggc

SEQ ID NO: 4197767 - RNA, 100 nt, Human
gucaggacucuguauucuauuuucagggacaagucuuguguaaguccucacugugaaauucaacuugucuuuguaaaauagaaaaccagauuuuuguaac

SEQ ID NO: 4197768 - RNA, 84 nt, Human
gucaggagggucccgagcccugucagaaauuccuccugacaaugaccacaugggcugucucacagggcuaggcccugcccuggc

SEQ ID NO: 4197769 - RNA, 93 nt, Human
gucaggaggucucucagcucucuaaggucuugcuuuuagcucuaacagagaggagguaggggccuuaaagaugcaugggagcccccuuuuggc

SEQ ID NO: 4197770 - RNA, 70 nt, Human
gucaggauguuuauucuccaguucacacccuguagagauaccaccagggguuggcaguguacguccuggc

SEQ ID NO: 4197771 - RNA, 65 nt, Human
gucaggcacuguucuaggugcagagcugcugcuccaaggagcuuacauucugagaggugauagac

SEQ ID NO: 4197772 - RNA, 81 nt, Human
gucaggcaguucuggguucaaaccccggcccccugaguagacaaggcuguggacacugagcucagagagagugugcuugac

SEQ ID NO: 4197773 - RNA, 55 nt, Human
gucaggcuagcccagugcuugggaguuacagcacucaagacacccuggccucuac

SEQ ID NO: 4197774 - RNA, 56 nt, Human
gucagggaaauggagaguguaguuuuauaaaaagucuucacugucuauuucuaggc

SEQ ID NO: 4197775 - RNA, 70 nt, Human
gucagggaggccagggacccagucagcggggcucugcccuugagcagcugacgcccuggcucucuuggac

SEQ ID NO: 4197776 - RNA, 68 nt, Human
gucagggcacagugacagcuccugcucuuccuggggcagugcagauagagcuguaguucugcuuugac

SEQ ID NO: 4197777 - RNA, 89 nt, Human
gucagggcaguguucccuucuggaggcugcagaaaagaaaguguugucuuguuuuuuccagcuucuagaggccgcccacauuccuugac

SEQ ID NO: 4197778 - RNA, 72 nt, Human
gucagggcucaggagaggcaggcgcugcaaugguuaacaaccgggauggggccugccuuccucucucuugac

SEQ ID NO: 4197779 - RNA, 56 nt, Human
gucaggucuuggaagauaggcuucucauacaacccaagccugucuuuugaccugac

SEQ ID NO: 4197780 - RNA, 68 nt, Human
gucagguuggcuugaagugauaucuggaguuugagacuguccagaccccagugcuacagcugccugac

SEQ ID NO: 4197781 - RNA, 79 nt, Human
gucaguaagucuugcuucugcucaaggggaggcaaauuaggcuucaccuuguaaacagagugccaaagaauuuauggac

SEQ ID NO: 4197782 - RNA, 67 nt, Human
gucagucauauuguacagauauguuuuauucuuuccccacacauauuagccuggaucugugacugac

SEQ ID NO: 4197783 - RNA, 105 nt, Human
gucaguccucugggccuugcugaaucccacccuccaguggacugucugugucuagguccaugggggucuugggauauuagaaaagaaucaagaauaaggaaggac

SEQ ID NO: 4197784 - RNA, 67 nt, Human
gucaguggggaggccaggauagaacuagagcuggugucccagguuccagucugggcucuucacugac

SEQ ID NO: 4197785 - RNA, 65 nt, Human
gucaguucacuaccacuccauuuguuuaacuuuagcuaagccaggguagggucagugucacuggc

SEQ ID NO: 4197786 - RNA, 76 nt, Human
gucaguugucaguuugauuugcuccaugaggcuauuguucuucuauaggagccauaaauaaaaucuguugauugac

SEQ ID NO: 4197787 - RNA, 64 nt, Human
gucaguuuccugguuuugauauugugcuacagcuauauaagaugucaccaccggaagaaacugc

SEQ ID NO: 4197788 - RNA, 111 nt, Human
gucaguuuuaagaagugcccucaauuacuaaccaaauaauguauuacaaauaacuaguuaugagguuuuacaguuguuuaauagggaguaauuggccccaauuaaacugac

SEQ ID NO: 4197789 - RNA, 85 nt, Human
gucauaauaagucuucuccuugguuuaugggacauguaggcaaaaaucuacauguguuuucuucuaaagggguuuuauuaaugac

SEQ ID NO: 4197790 - RNA, 75 nt, Human
gucauauuuaggccuuuaauucauuagaaguccaccuuugauugcaguuauagguuuaaauucaguucuaaugac

SEQ ID NO: 4197791 - RNA, 62 nt, Human
gucaucaacauauaggcaaccuguaaguuauuuaccuuaaaguuugccuauguguuguuuac

SEQ ID NO: 4197792 - RNA, 70 nt, Human
gucaucacacauuuacccuuguauaggcaaaccccguguaugcuguucuacaaguguaagcuugugagac

SEQ ID NO: 4197793 - RNA, 55 nt, Human
gucaucagcauuggagauccagcacagaugugcuuuuuguguccaggccgauggc

SEQ ID NO: 4197794 - RNA, 61 nt, Human
gucaucauuaccaggcaguauuagagaccugacuccauccaaugcugcccaguaagauggc

SEQ ID NO: 4197795 - RNA, 67 nt, Human
gucauccacagaaucgcuaguggagcaucugauacgcaggugcuccgugauggacugugacgauggc

SEQ ID NO: 4197796 - RNA, 69 nt, Human
gucauccucccaguauuuacauugugagccuggaugguuagucauugucuuacauacuguggaggaugc

SEQ ID NO: 4197797 - RNA, 73 nt, Human
gucaucuucgauacuucagggggcuaaaucccagcaagaccuugcugaaguucuuccccuaaugaagauagac

SEQ ID NO: 4197798 - RNA, 61 nt, Human
gucaucuuugcccugugcaggacuuuggagaggaugauucccuguacaucaccaaggugac

SEQ ID NO: 4197799 - RNA, 59 nt, Human
gucaugaacaucuacagugagauguuagacuuugucgauaucucaaaaguggaguagac

SEQ ID NO: 4197800 - RNA, 79 nt, Human
gucaugaauuuggcuuuagauuucuagaaccugacccaaagagggaaaucaguucugaaauuuacacugcuuuuaugau

SEQ ID NO: 4197801 - RNA, 106 nt, Human
gucaugaguucaguguuaaucaaucaacaguauuaaauaaggugucuuuaaacagaaaaauacaaaacauggugauguuuugauugauugauaaauauauugugac

SEQ ID NO: 4197802 - RNA, 57 nt, Human
gucaugcacuacauaacgauguuuuggucaaugaccgaccgcguguagugucguggc

SEQ ID NO: 4197803 - RNA, 67 nt, Human
gucaugccaauagugaauuauuagaucuuuuucuuagagcugucagaugauacacuguugucaugac

SEQ ID NO: 4197804 - RNA, 60 nt, Human
gucaugccagcggagcucgggaggccugccgcgccgcaccgagaagcugcugugugugau

SEQ ID NO: 4197805 - RNA, 66 nt, Human
gucauggagaaccuuguaggccacaguacauacaaggcuuuggaggguucuuagcaaaaaagugac

SEQ ID NO: 4197806 - RNA, 72 nt, Human
gucauggagugugcagcaugcucugcuaggagcuguggaaagauucagaagcaggagugugcacaaaaugau

SEQ ID NO: 4197807 - RNA, 62 nt, Human
gucggcgcuggaacgcaguagcuccucuggcggcagcagcacugugagcaccagcacgccgc

SEQ ID NO: 4197808 - RNA, 91 nt, Human
gucggugcaguggauacgcucguggaugcgcagggcggccuugcuggagcaggaguagcugcauuccgagcacuucucaggaugcuccgac

SEQ ID NO: 4197809 - RNA, 68 nt, Human
gucgugcaaucuguguuuguaaagggccuucccaggucuuggcaaguggcagauucuugauacacgac

SEQ ID NO: 4197810 - RNA, 66 nt, Human
gucgugugggucauauuauaaauguucuguucuuaaugaaucuguauguuaguaugacauuaugau

SEQ ID NO: 4197811 - RNA, 113 nt, Human
gucuaaaaauuucugacaauuuaagccaaaagcagcugucugugaauccuucuaagaagaauuuaaacuguuuuugcucaaaauauguccagcauuuauucuauuugagagac

SEQ ID NO: 4197812 - RNA, 59 nt, Human
gucuaaaugcuguguuuuaacauagauaacuuaucuguuguauuacacagauuucagau

SEQ ID NO: 4197813 - RNA, 82 nt, Human
gucuaauagcauaaaauuugcuacuguuaaauaaaugcuuauccccugcauaauuuacagguagaauuuuaaguaauuggau

SEQ ID NO: 4197814 - RNA, 66 nt, Human
gucuaccacaguaugaaaucugaaauccuuacauggaauaacagauuuucaagcuguggguaugac

SEQ ID NO: 4197815 - RNA, 61 nt, Human
gucuaccucucccuaccaagcaccagagccccucugccaucuucuuggggagcagcuagac

SEQ ID NO: 4197816 - RNA, 56 nt, Human
gucuagaaaaugccgagggauguucuccacccuugucuauaaaugcacuucuagau

SEQ ID NO: 4197817 - RNA, 56 nt, Human
gucuagagaggaaggaagugugugaaggugaacaugacuuccugugucccucaggc

SEQ ID NO: 4197818 - RNA, 62 nt, Human
gucuagaugacauauuuuagacuacuguuaucaaauugagugauuuaggauaaagucuggac

SEQ ID NO: 4197819 - RNA, 58 nt, Human
gucuaguuaucuuugauuauaugcauaauauugaugacauauugcaaggaagcuggau

SEQ ID NO: 4197820 - RNA, 56 nt, Human
gucuauaagcaggggaaaacuucauagugucagaagaaacuugucugcuucuaggc

SEQ ID NO: 4197821 - RNA, 79 nt, Human
gucuaugaggcccucuugccacaaugaaauguguaaauauuuguaaauuuacuucagcugccaggauggguaacaugau

SEQ ID NO: 4197822 - RNA, 66 nt, Human
gucuauugugauguugugggguuuguugggggcaugugauaaauaauuuccacauaaucauaagac

SEQ ID NO: 4197823 - RNA, 55 nt, Human
gucuauugugcccugggcugauuauguuccacacagucauucaggaccaguggau

SEQ ID NO: 4197824 - RNA, 94 nt, Human
gucuauuuagugccaggcacugugcuagauccuugggguagagucauaaaacaaucugagauaaggaaacaguacaguguggaauuugauacac

SEQ ID NO: 4197825 - RNA, 73 nt, Human
gucucaaaauuaagcccagguaucuggacagucauguaccccaagaccucugaaguaccugguguucugggac

SEQ ID NO: 4197826 - RNA, 130 nt, Human
gucucaacagccacgggacuugguggccaagccugggaagagcccauugucuucuugcaucaccacuggcuguguggcugcuggcuagcuugcuuguucauuauuuguuuuguggaggcugcccugaguc

SEQ ID NO: 4197827 - RNA, 122 nt, Human
gucucaauauacugcuuucaaggguuguugaaaacuguaugcaaauuuauuagcacagugucuggcccuugcuauaaaugguuucauauuaucacauuucuaugagagcagugaucaaguac

SEQ ID NO: 4197828 - RNA, 59 nt, Human
gucucagauucagacaucuacagguaauuuggaucaguaaagggugcuggauuuaaggc

SEQ ID NO: 4197829 - RNA, 64 nt, Human
gucucaggauguggguuuucacauugugugucucgcacaguaguacacaucuauguccucagau

SEQ ID NO: 4197830 - RNA, 75 nt, Human
gucucaguuuucucaucagucaaauggagacacaauagccuguuucacaacguuguggugagaguuaccugagac

SEQ ID NO: 4197831 - RNA, 56 nt, Human
gucucauagauauucauguaguagagcuuggacugucacagaaauguaagugagac

SEQ ID NO: 4197832 - RNA, 75 nt, Human
gucucauccugcauuucuuucucaugugguacucccagugggaguucugcaugaaaaaggacuacgggauugggc

SEQ ID NO: 4197833 - RNA, 74 nt, Human
gucuccaaccagagguauggcacuauccucucugauagcaaaucaagagcacagugcuggcaucuggugaagac

SEQ ID NO: 4197834 - RNA, 60 nt, Human
gucuccagaauucuugggagggcucugcccacagcuaccccccaccucuucuggccaggc

SEQ ID NO: 4197835 - RNA, 76 nt, Human
gucuccaggcaccaacuggcagucccaggaaguuccuucaucacagggccugccuggcugccgagugugcagcgac

SEQ ID NO: 4197836 - RNA, 78 nt, Human
gucuccaggcuuccacaggcaucacuuugugucucugauaugacucagggcugaaguuauggcugagcuuuuaaugau

SEQ ID NO: 4197837 - RNA, 71 nt, Human
gucuccaucccugggucagcccuuuccugccaugaauucaggaaggcagaggcagcucagcagauggggac

SEQ ID NO: 4197838 - RNA, 76 nt, Human
gucucccaaaauauacuuccccauuaugggggcauuucaaaaucucccuguggguaauguguaacuaaguggggau

SEQ ID NO: 4197839 - RNA, 130 nt, Human
gucucccaacuugagcuguaugaaggcucuuggucucccugggaguugguggaggguggaggcagccugggcuucccuguacacuaacuugagaccagugcaauaaaaguacacaccuuaaaaaaaagac

SEQ ID NO: 4197840 - RNA, 63 nt, Human
gucucccagcugguaagugauggagccaggaguugcauugccuucucacuuauaagcugugac

SEQ ID NO: 4197841 - RNA, 67 nt, Human
gucucccaggcagccccagaagcuugcuccaggccaaaacuuggcaagugcggugcugccuggggau

SEQ ID NO: 4197842 - RNA, 70 nt, Human
gucuccccagggcccucuucauguccguguuccucaggcuguagaugaagggguucagcaugggggugac

SEQ ID NO: 4197843 - RNA, 60 nt, Human
gucucccccgauggaauucuuuggcuugguuauggaagauuucagaguuugggggaagac

SEQ ID NO: 4197844 - RNA, 93 nt, Human
gucucccugccccgagccaauguccuccugccugcgacuggccuaugacagcguaggacccagaggcagaggacguggcauugccauggcgac

SEQ ID NO: 4197845 - RNA, 66 nt, Human
gucuccgcccgccgcccgggcccacggccgcucggcugcggcucggccccgacggccggcggcggc

SEQ ID NO: 4197846 - RNA, 79 nt, Human
gucuccgcugagugacauuugcaccagcugcuuccaaagggaguagcuuuggugaaaugucaccggcuucagcggggau

SEQ ID NO: 4197847 - RNA, 123 nt, Human
gucuccucccccuacuccaccucccugucgggcacauggcggccagcaggugauccucucugcaugcuccauguuccugucucugucugccugccugucuguguagguggcuaguguagagac

SEQ ID NO: 4197848 - RNA, 76 nt, Human
gucuccuccuacauguaagacuagcuuaaaguuauuuaaccucuagacuuuuaguuucuacaugugugaaacagac

SEQ ID NO: 4197849 - RNA, 64 nt, Human
gucuccugaggcauccauugaaguucuauuuuuuaauaaagaguaucaaaggcuuuuaggagac

SEQ ID NO: 4197850 - RNA, 68 nt, Human
gucuccugaugaugguacuggcauuucauaucaaagccaugcuugccagugacugucgcucauuaggc

SEQ ID NO: 4197851 - RNA, 76 nt, Human
gucucuauucacauggaaauuacuauucuagagaaaucaugguaauuuagugauuccaaugugaaguggaagagac

SEQ ID NO: 4197852 - RNA, 57 nt, Human
gucucucaaaacuagaagagaaagguguuuuuuccacaucagucuaguuuugaagac

SEQ ID NO: 4197853 - RNA, 82 nt, Human
gucucuccugcaagguggggaaaggaaaguuaaccugccaguggguucgaagcccuuccugacuuucauacaggagccgggc

SEQ ID NO: 4197854 - RNA, 58 nt, Human
gucucucugacugguccacaccaaaggagaaagaaguuugagacaaggcuggagagac

SEQ ID NO: 4197855 - RNA, 81 nt, Human
gucucucugcucucuggauccuucucuguguauuuugcugcccaaagccccaagagacagcaucuguuuggcuggacagac

SEQ ID NO: 4197856 - RNA, 71 nt, Human
gucucugaaccagggagccaggaacgcaggucggacacaucuuuggcaggcaaguucagcuccaccaggau

SEQ ID NO: 4197857 - RNA, 59 nt, Human
gucucugacaagcugagcgaacagcacuugacaguuggagcacagcugaguucaggguc

SEQ ID NO: 4197858 - RNA, 74 nt, Human
gucucugagacuuagcaucuacauuuuucauaaaauggagacucuauguguagaguguguaaguaucaacugac

SEQ ID NO: 4197859 - RNA, 114 nt, Human
gucucugcugaucugugcacuuaguucaguauuugagguuucggucacgguugugaaaacuacugagacugaaucugaaugauggauuacuucugaugcaugucugccagaggc

SEQ ID NO: 4197860 - RNA, 75 nt, Human
gucucuuccccucaggauagauuguccucucaugcauaugcugaagagucgucuuucuugacauaggccagaggc

SEQ ID NO: 4197861 - RNA, 76 nt, Human
gucucuugacugccaccuggugguccuggaagugaauucacccucuaggagaaccaucagggagguggccagaggc

SEQ ID NO: 4197862 - RNA, 68 nt, Human
gucugaaacaaguuuaagggaucuauguuaaagcugccuaagcauagauauguauacuuguuugaggc

SEQ ID NO: 4197863 - RNA, 83 nt, Human
gucugaaaccacugaugguaccaagucccauacaggugaaguaucccuuaucugaaacguuugggaccagaaguguuucagau

SEQ ID NO: 4197864 - RNA, 60 nt, Human
gucugaaauggaggugggaacuuuuccaauaugaacgauuauucccacugacauucugau

SEQ ID NO: 4197865 - RNA, 61 nt, Human
gucugaagaaucccagggaauuuggccucuuucccagucaggcuccaaagauucuucaugc

SEQ ID NO: 4197866 - RNA, 62 nt, Human
gucugaagcaaucagaguccuuuggccugacaggugggaccuugcccaaggagucugaagac

SEQ ID NO: 4197867 - RNA, 79 nt, Human
gucugaauccaguuuuuccuugcugaggacccggucgaggagcaaugagugggaguagggaggaaaaaucaugucaggc

SEQ ID NO: 4197868 - RNA, 59 nt, Human
gucugacagccagcuguugggucuuccaucguuuuuaaccuucaggugagcacacagau

SEQ ID NO: 4197869 - RNA, 79 nt, Human
gucugacucgauaagcacaggagacgcacagccaggcccuggcuaucuggccucgugaccaugguuuuucagauuagau

SEQ ID NO: 4197870 - RNA, 61 nt, Human
gucugacucuaaagccugucuucuuucuccuaaacauuguggacaggugcuaaagaggggc

SEQ ID NO: 4197871 - RNA, 63 nt, Human
gucugacuuuucaguaggagaaaggaagcugaugaggaauccaguucuccuuugaacagugac

SEQ ID NO: 4197872 - RNA, 56 nt, Human
gucugagacccacucccagagauucugauuucacugggcugaggugugucccgggc

SEQ ID NO: 4197873 - RNA, 57 nt, Human
gucugagcacccuggccugucaucagcgagaguccuguugggucaguguauucagau

SEQ ID NO: 4197874 - RNA, 73 nt, Human
gucugagcgcuggagcuugugugugguuaaaagcauuuuguuuucauguaagccacaggcuuacaguuuagau

SEQ ID NO: 4197875 - RNA, 56 nt, Human
gucugaggaagaugcagggggaauugucugaagcacccccuggcuccuucuaaggc

SEQ ID NO: 4197876 - RNA, 59 nt, Human
gucugagggguuucccaggacacaggacauucaaugcuaaaaccagagaugccucaggc

SEQ ID NO: 4197877 - RNA, 65 nt, Human
gucugaucuuucaagggaagccagcaaaguggauuuuuaugugaagucucuugaauaggucaaac

SEQ ID NO: 4197878 - RNA, 64 nt, Human
gucugauuuaugguagaaaaacugaguccccaggaacuggggaagugacuggcaagaagaggac

SEQ ID NO: 4197879 - RNA, 74 nt, Human
gucugcaagccaaggagaauggccucaggagaaaucacaccugcugcugauaccuugaucuuggacuuccagac

SEQ ID NO: 4197880 - RNA, 82 nt, Human
gucugcaaggcuuggagguggcgccaggggcagcugcugucuucagugcugacuucucccugggguuccuccagccacagac

SEQ ID NO: 4197881 - RNA, 59 nt, Human
gucugcagcuucuugccagagaggcucuaucugauuuucugaugcaagaagcugcaagc

SEQ ID NO: 4197882 - RNA, 72 nt, Human
gucugccagugguuuggcccugaacaccuguuauucaggucacacuugucaggagcuagucuagcuggagac

SEQ ID NO: 4197883 - RNA, 61 nt, Human
gucuggcuagagacacccucccucucuggggagcaaguugggggugucucuguuuccaggc

SEQ ID NO: 4197884 - RNA, 57 nt, Human
gucuggcugugugacaguguuuuuuggucuauuuccagucacacugacaugccacac

SEQ ID NO: 4197885 - RNA, 88 nt, Human
gucuggcuguuuccucacuggauuucgcuuuugaaaaacauuuuucauccacauuuucagucauggauucacugaggagauauuuggc

SEQ ID NO: 4197886 - RNA, 62 nt, Human
gucuggcuuggguagguaguucaaugauucaacaaacacugagcaccuaccuggagccaagc

SEQ ID NO: 4197887 - RNA, 64 nt, Human
gucugggcugugccaaagcucuuccuugugcaucagagcaggagcucacacccacagccagggc

SEQ ID NO: 4197888 - RNA, 98 nt, Human
gucugggggacaggcacagcugacaguucugaccaguggccaccugaaaaucagggccagggccuggggacuguccccucugccuccauccccugggc

SEQ ID NO: 4197889 - RNA, 66 nt, Human
gucuggucccaucaaaugcaauugaagacgugaaaacacaaaguauaacuugauggaaagaccgac

SEQ ID NO: 4197890 - RNA, 91 nt, Human
gucugguguggaagggcauugagaggcugccugccugacacugccuugccugucacgcggguguagcuuucucaauucccauccugccgac

SEQ ID NO: 4197891 - RNA, 102 nt, Human
gucugguuugcauguuuaguuucauuugugggaacugcuuguccaagagugagcucaggucagggcaguuugugccuaugagaauuagcucagcuaucaggc

SEQ ID NO: 4197892 - RNA, 55 nt, Human
gucuguacccacguccugcuaguuuccugcuagcuugugacagugggguggggac

SEQ ID NO: 4197893 - RNA, 71 nt, Human
gucuguaucucuauuacuacaucagccagguuguuaaacugagguugaaauagugauguaugaccccagau

SEQ ID NO: 4197894 - RNA, 85 nt, Human
gucuguauugcuguacuucaaauuucaugaacuguaucaaagcugguaacauaugacaugaacauucagaaauacagcuacagau

SEQ ID NO: 4197895 - RNA, 74 nt, Human
gucugucagugcugcccagggcugaguguccugagccccagauucucgguccgggcagcccccacugacauggc

SEQ ID NO: 4197896 - RNA, 60 nt, Human
gucuguccacuuggaagcucccucuggggcuguguacucaaggagcgucugagggcaggc

SEQ ID NO: 4197897 - RNA, 67 nt, Human
gucugucccugauacugguuaacaggaauauguggcauuuacaguuaucugcagauaagggaaagac

SEQ ID NO: 4197898 - RNA, 58 nt, Human
gucuguccucgcggagacggugaugggccuuucccucucuguacagaugaggacacac

SEQ ID NO: 4197899 - RNA, 56 nt, Human
gucuguccuuuucaucucccaaucaccgacauggugggagauguugagggcagugc

SEQ ID NO: 4197900 - RNA, 58 nt, Human
gucugugccugauuuucaguacuguaugccuuauaguuacagaagauaaggguauuac

SEQ ID NO: 4197901 - RNA, 80 nt, Human
gucugugcuggugauuacaaugaugacaaugaugaaguugaucagagcuaacauuuauugaaacuuacuaugugccagau

SEQ ID NO: 4197902 - RNA, 58 nt, Human
gucuguggcaggggagaaguuugggcaagucacuagaugcuccuuuaccccacaagac

SEQ ID NO: 4197903 - RNA, 79 nt, Human
gucuguguuucauguacuuuuuugauagacagcauuuuuuuguggagcauuuuguuguuagaguaugugaaauguugau

SEQ ID NO: 4197904 - RNA, 88 nt, Human
gucuguuuauucucaucuaaaauggccuuaauccuacuugucccacagggcuuuuuugaaaaagaugaugaugaucauaauaacagac

SEQ ID NO: 4197905 - RNA, 74 nt, Human
gucuguuuggcccuuuuugccccuucugcuuuccucaugaggaugcagcaagaggugccaucuugaaagcagac

SEQ ID NO: 4197906 - RNA, 75 nt, Human
gucuguuuucauagcaucauguuggcaugucaucaguagagaggauagacuugacagggugacuuugugacagau

SEQ ID NO: 4197907 - RNA, 94 nt, Human
gucuuaaaugcuucaugggauaggagaugauccaaugggaacugaauguuuucaauuaggauguuuccauggauacuauuaagcaugccaagau

SEQ ID NO: 4197908 - RNA, 104 nt, Human
gucuuaauggauagaggcagacaucaccaauaaugggaccaggucacuaggggaaauccacugggcuucacucauaauuagguucuguuuugauucccagagau

SEQ ID NO: 4197909 - RNA, 104 nt, Human
gucuuacuuucccaaacuuuuacuuguguauaggugugugugugugcaugcaugcacacaugugugcauucacaugcaugccucugacauauaaaggugaagac

SEQ ID NO: 4197910 - RNA, 70 nt, Human
gucuuauggcaguuuaaguuugaaugcugaaauuaauuuuugacagccccaauaaacugcacauugagac

SEQ ID NO: 4197911 - RNA, 67 nt, Human
ggucauuggcauuccuuccuccuccuccuccugggagugggguggauuucaggcggugucaaaggcu

SEQ ID NO: 4197912 - RNA, 76 nt, Human
ggucauuuagucaugucuuaucaguccucucucugaaaaauacagaugaugauaauugaaaggcacauaaguuucc

SEQ ID NO: 4197913 - RNA, 74 nt, Human
ggucauuugccaauucagcaguuccugcuucagugccuugugacaucaggcaggaugcugucugaagaaugauc

SEQ ID NO: 4197914 - RNA, 65 nt, Human
gguccaaagaguuagaagaugugguuccugcccucagggagcuaaaucacuuauucuuucaugcc

SEQ ID NO: 4197915 - RNA, 72 nt, Human
gguccagacuaagaugggccuaggauucguuuucuaaauggaaaugucugaggcucaucugagguuggcauc

SEQ ID NO: 4197916 - RNA, 57 nt, Human
gguccagcacaacacuggcaugagccaacaggagccacgccggccaccugcugggcc

SEQ ID NO: 4197917 - RNA, 59 nt, Human
gguccauuuccccugaaagcaaccuccugacaugugugaggugggcagguggaguggcc

SEQ ID NO: 4197918 - RNA, 60 nt, Human
ggucccaaacuccugaccucaggugauccacucgccugggccucucaaagugcugggauu

SEQ ID NO: 4197919 - RNA, 69 nt, Human
ggucccacuaaguucuuuucuauguaauaugaucguuuuaaugagggauaggacauggaugagggcacc

SEQ ID NO: 4197920 - RNA, 56 nt, Human
ggucccagcccuggagcccuggucgggguagaggaccaggaguugggggugggacc

SEQ ID NO: 4197921 - RNA, 57 nt, Human
ggucccaggggagcucucugauuggcugugcuugggccagucauuaucuccuggacc

SEQ ID NO: 4197922 - RNA, 72 nt, Human
gguccccuguucagggcgggggcucaaccaguggaucuuuauucuauuagcaauugcccugugcaauagacc

SEQ ID NO: 4197923 - RNA, 82 nt, Human
ggucccggccuugucucauguagaagagaugguuccaggccacauaggccugagcuggucugcugcauggaguggccugacc

SEQ ID NO: 4197924 - RNA, 75 nt, Human
ggucccuaaagagucuuaucuuuuacaaguacauacugaaauauuuacggaugaaaugauaugaugucagggauu

SEQ ID NO: 4197925 - RNA, 56 nt, Human
ggucccuauuguauaaauuagauugaaugagucuuauuuuuauauggauagagacc

SEQ ID NO: 4197926 - RNA, 82 nt, Human
ggucccugaggagauccccccagaaguggugcaggaguauguggacaucauggaggagcugcuggggccuucucucggggcc

SEQ ID NO: 4197927 - RNA, 66 nt, Human
ggucccugcccuccugggacucagagcuucaccuucucaucucugaggccacaguggggugggacc

SEQ ID NO: 4197928 - RNA, 59 nt, Human
ggucccugguucccucugagcuugggaggacuaugugagacagaacaggaccaggggcc

SEQ ID NO: 4197929 - RNA, 56 nt, Human
gguccguggagauuuugugcaggguuauuucaaaucccccacauuaguuccaugcc

SEQ ID NO: 4197930 - RNA, 118 nt, Human
gguccucagacucccuccaggcaugugccugccugugcuguucccucugccaggaaugcuuccuugcagauacacgcaugcauggccagcucucacaccuccuucaagucugcugacc

SEQ ID NO: 4197931 - RNA, 85 nt, Human
gguccucggguuuuucaguugggcaauuacaguaugcuuaggaguagcuucagcuuuuuggauugcccaagucagcccugggauu

SEQ ID NO: 4197932 - RNA, 57 nt, Human
gguccucuccagcgccacagugcccgaccagcaggcgcugggccgcugcgaggggcc

SEQ ID NO: 4197933 - RNA, 60 nt, Human
gguccugccuguucccucugucaccuugcugccauugcaacagcagacaggcuuaggacc

SEQ ID NO: 4197934 - RNA, 73 nt, Human
gguccugggauuuccugagcacucucuggggacaaagcucuauacuuggagagugcaggggaagcccagggcc

SEQ ID NO: 4197935 - RNA, 77 nt, Human
gguccuggguacuggggccuggcuguauuggaggggaacagccagcccuucaguguugccagggccuagcuaggauc

SEQ ID NO: 4197936 - RNA, 56 nt, Human
gguccugguuagcggcuuucagaugucuaccuuugacagcugucuuagcuugggcu

SEQ ID NO: 4197937 - RNA, 61 nt, Human
gguccuguccauuuucgugccuccuuuuaucaguaaagaggacagucaaauggccggugcc

SEQ ID NO: 4197938 - RNA, 79 nt, Human
gguccuuaguaacagaaagucaugcucauuugguggugacucaugucaaauggggaugucauuuucguauaguaggacc

SEQ ID NO: 4197939 - RNA, 55 nt, Human
gguccuucccccgggcucccuuuuuucaugcagaauggagucaggggaaugggcc

SEQ ID NO: 4197940 - RNA, 118 nt, Human
ggucgauaccaccugggccccuccuccagcuugagcccgaaucugcagcauccuggucucccauccuggagggcugcagcgaggcugcugcagagggaagcagaagguucuguugacc

SEQ ID NO: 4197941 - RNA, 63 nt, Human
ggucgccucaggauggaagccuacaggaagggaauuccugagcugacacuuggggagugggcu

SEQ ID NO: 4197942 - RNA, 89 nt, Human
ggucgcucugggggauugguagagcucuguucacucccgggccaggccgggcucauggacagcucuccagccagagaaagaaaccgacc

SEQ ID NO: 4197943 - RNA, 69 nt, Human
ggucgggauguucucaaaaaacgugugcaucgcuggaaaugugagguccugcauguugaggucuuggcc

SEQ ID NO: 4197944 - RNA, 71 nt, Human
ggucuaaugaacacauauuaggugcucaugaccuguuguggaaaugggcacauaguaggugcgcaggagcu

SEQ ID NO: 4197945 - RNA, 90 nt, Human
ggucuacagacucuagcucaagcuacaggaucaagguucuacccacagaagguuggcaucugagcuguguaugguucuaaggcuuagacc

SEQ ID NO: 4197946 - RNA, 75 nt, Human
ggucuaggaugggaucagggcucaggugcggagagacagaguuccuccagguagcuaaguccuggggcuuggacc

SEQ ID NO: 4197947 - RNA, 63 nt, Human
ggucuagguguauguccuaauuugauguguucaaauacaauaauuaagucacacaccuaaacc

SEQ ID NO: 4197948 - RNA, 69 nt, Human
ggucuaguaaugaagaaaugccauaacuucuucauuucaccaagggggcauuuauuucuuuacugcauc

SEQ ID NO: 4197949 - RNA, 64 nt, Human
ggucuagugaauguuugcuguuacuguuuuuuguuagcagcagcagccguagccuuauuacucc

SEQ ID NO: 4197950 - RNA, 58 nt, Human
ggucuauggggccaagaaggucucaugugcauccccauaugggacuagggcccaggcc

SEQ ID NO: 4197951 - RNA, 92 nt, Human
ggucuauuagaaugaacagaucagccuaguacucauuucaaauauguaauugaguaauaauugaucuuggcuuagaauuuuaauuugagacc

SEQ ID NO: 4197952 - RNA, 73 nt, Human
ggucucaaacuugugggcucaagcaauuugccugccuuggccucgcaaagugcugggauuacaagugugagcc

SEQ ID NO: 4197953 - RNA, 62 nt, Human
ggucucaacugaacugauaucaacuaucagaugugugaauagugauaucuuuagaugauucc

SEQ ID NO: 4197954 - RNA, 93 nt, Human
ggucucaccauucccauauccccugacagcaugaccacagggucugguuccaugugacccaucuucacugugggaaaugggugguggguagcc

SEQ ID NO: 4197955 - RNA, 59 nt, Human
ggucucagugaaggagugugcugguccagauucagcugccacugauugccuuugaggcc

SEQ ID NO: 4197956 - RNA, 57 nt, Human
ggucuccauuccuucaucucacuucauggggacugaaugagauccaggggugaggcc

SEQ ID NO: 4197957 - RNA, 71 nt, Human
ggucuccugcucugcugaucagugucucauagggcaaguccugagggaucugggacaacaggugguggacc

SEQ ID NO: 4197958 - RNA, 75 nt, Human
ggucuccuugggaaagcaggaauuaaaggggucaucacuuucagccuucccuuaaucuguuguuuuagggagucc

SEQ ID NO: 4197959 - RNA, 81 nt, Human
gguguuagagugggaggcuggcauguggugaauauuauagagaacauaaaauaguuaauccauuucaguguuccacuugcc

SEQ ID NO: 4197960 - RNA, 58 nt, Human
gguguucugggaugauuguaguguucucugaaaagaguaucauuguuuccagaagacc

SEQ ID NO: 4197961 - RNA, 75 nt, Human
gguguucugucagcuuucauuuauggggaaccugcuaagacccugaaaugacuccagcugaguuacagcaaggcc

SEQ ID NO: 4197962 - RNA, 56 nt, Human
gguguugcaguugaagacugguaaguuugccaaucagaucuuccaacacugacacc

SEQ ID NO: 4197963 - RNA, 63 nt, Human
gguguuguaaauacagcagauaauugaaauuuagauuucagauauaggcacuguuagcagccc

SEQ ID NO: 4197964 - RNA, 89 nt, Human
gguguuuagagcuggagacaaggagaccagcauuugucaagcacuuucuaagccccagacucugugcuccuugcuuucucugcauuacc

SEQ ID NO: 4197965 - RNA, 74 nt, Human
gguguuucuugcgucuguaguguaugguguggguguuagcaaacuccauacaauggcaggcugugaggaagucc

SEQ ID NO: 4197966 - RNA, 67 nt, Human
gguguuugucaggauuggggucaugagucuuuuaguggaagcauucauguccuuccugaacggcacu

SEQ ID NO: 4197967 - RNA, 73 nt, Human
gguguuuuccacaguguggcauaaacuguaagucaaggauguauuaguuaucuauugcuguguaacaaauacc

SEQ ID NO: 4197968 - RNA, 96 nt, Human
gguguuuuucuuagagcccagaaaaugcagaacauagaaucucuagggaaaccagcuucuauggucuguagcugguuacuucuaaaaaaaacuacc

SEQ ID NO: 4197969 - RNA, 85 nt, Human
gguuaaauuugaauugagaucugcaucauaagcucagaaacacugaguguaugcagguuuucaauguuuuucuauuauuuaugcc

SEQ ID NO: 4197970 - RNA, 64 nt, Human
gguuaacaagaauuacucuggaaguaauauuuuuaugucuauccaguaguuauuuuugcaaacu

SEQ ID NO: 4197971 - RNA, 60 nt, Human
gguuaagcuucagaacgcaaugaugccuugcuuuccuggcgucuccacuggggguuaacc

SEQ ID NO: 4197972 - RNA, 72 nt, Human
gguuaauaaguaaaccacagagaagccacaaaggugccuacaugugguuguuguguaguuuaucauuagacc

SEQ ID NO: 4197973 - RNA, 101 nt, Human
gguuaauagaaaagauuuguuccucuguuuauucaauuucuauauaucagagacuugguauuaggaguauaauagcagaggaauaaaaacaugauguugcc

SEQ ID NO: 4197974 - RNA, 76 nt, Human
gguuaauuauagugucuguagaaccuuaacugcuguaagcuuuccagcagacuccacagacguguuauuaguugcc

SEQ ID NO: 4197975 - RNA, 112 nt, Human
gguuaauuucuuuacuauagucauaaaagugggacuucaccuugucagagagaaagccucucugaguaagugacaguucagcugaaaucuaaagguuaaguagguauuaacu

SEQ ID NO: 4197976 - RNA, 61 nt, Human
gguuacagcugaguuuagguacaggaaaaaggauuccucgcgcucucaucaagcuguaacu

SEQ ID NO: 4197977 - RNA, 112 nt, Human
gguuacaggaguaucuuaaaaaggugauugcagauucggcugcucaggauauaguguugcgguuauuagcuuuugacaaugcuaaucucaauugccaggcugcucugugacc

SEQ ID NO: 4197978 - RNA, 56 nt, Human
gguuacagugagaagauagccuacgaggaagugggcccucaucagacacugaaacu

SEQ ID NO: 4197979 - RNA, 75 nt, Human
gguuacccaacuguuauaaaucaacagagaggcacggggagagcauucuguagagcagugacagugcugguaacc

SEQ ID NO: 4197980 - RNA, 55 nt, Human
gguuacuuggugcuuuccccucuggauccaaggcuagauaaguuuccagguaacu

SEQ ID NO: 4197981 - RNA, 68 nt, Human
gguuagacagaguaucuaucaggaguauaacuuccacucugaguaauguccugugaugcuuaaugacc

SEQ ID NO: 4197982 - RNA, 116 nt, Human
gguuagaugggaugggacacucaauacauuuuguuucuuuuucauugcucagagguaaacucaguguccaaaaagaggcaagagaaugcauuaagaauuuccuugccuaaauagcc

SEQ ID NO: 4197983 - RNA, 70 nt, Human
gguuagcuugcugaguuguccuuagggauagcauuuucuguucuuacaaguaugacguagcaggcuggcu

SEQ ID NO: 4197984 - RNA, 78 nt, Human
gguuaggcuuuguguuuugggaacauccagagaacaucuucuaaaggacaaagaugugcugagagcauaaaguuaacc

SEQ ID NO: 4197985 - RNA, 82 nt, Human
gguuagguuugagucccuuuuaaaacugucaguaggagacacccuacggaguauuuacaagaggaaaauaagauuuaucgcc

SEQ ID NO: 4197986 - RNA, 78 nt, Human
gguuagugugguuuuuuagagcaaugcuuggcggucauaaagcaaaugcauuaagucagaacaauagguacauugauc

SEQ ID NO: 4197987 - RNA, 65 nt, Human
gguuaguuagcgaauguguuuugcauucaaccaaggaaguucaaaauacugucucugagagagcc

SEQ ID NO: 4197988 - RNA, 78 nt, Human
gguuauagcagucucuuuugucucaccaguaucaaaaacagagcuggcacagaccaggagaucagaaaauguugagcc

SEQ ID NO: 4197989 - RNA, 74 nt, Human
gguuauauuguccugcagaugguaauauguugcagauacuuaucuucaaauuaccacauuugcuuauguuuacc

SEQ ID NO: 4197990 - RNA, 57 nt, Human
gguuaucaucaccuuuggcaguagcuggaaccaagguuauacuaggucaugauaauc

SEQ ID NO: 4197991 - RNA, 58 nt, Human
gguuaucauuguugacaugauuguuaucaugaugaugauaaugaugacaaugacaacc

SEQ ID NO: 4197992 - RNA, 83 nt, Human
gguuaugaaagagcaggaguguucuagauccacugccggaucccaguggaggcuggcagggaguggagacucccuagaagacc

SEQ ID NO: 4197993 - RNA, 84 nt, Human
gguuaugacguauccuugaaugcuauguuuggacuuuguucagugucaggcaaaggaagguauuugaaaggagaagugaugauu

SEQ ID NO: 4197994 - RNA, 68 nt, Human
gguuaugcaccugcucacacaugugacuguucuuucacaucaccaguuuggguugggaugacaugacc

SEQ ID NO: 4197995 - RNA, 55 nt, Human
gguuaugcaggaugcacgucuucagcugcacugaaucaugccauuuugcuuaauc

SEQ ID NO: 4197996 - RNA, 64 nt, Human
gugaugaaugaugccaguugaaaugccucaugcuucugacucauuucagaaccauuaucaucuc

SEQ ID NO: 4197997 - RNA, 56 nt, Human
gugaugaggcuucuuggugaacauaguucagucugucuugauuauuggccucacac

SEQ ID NO: 4197998 - RNA, 111 nt, Human
gugaugaguauuugauaacacuacaucauccacaacuuagaagaagcauuuuuugguauguuacuucugugauuugguuaggauaugugguuuggacacagugaucauaac

SEQ ID NO: 4197999 - RNA, 57 nt, Human
gugaugauaagucuuuagacagguucauauuguccugucaucugaauuucucaucac

SEQ ID NO: 4198000 - RNA, 85 nt, Human
gugaugcaaucuucaggcaaauaggguguuuuuggggguucugaaagaaagauuuuguuucauuugguuugguagauuguauuau

SEQ ID NO: 4198001 - RNA, 61 nt, Human
gugaugcccagaacccccuggauggaggggagaccccaggcagaggggucuggagcaggac

SEQ ID NO: 4198002 - RNA, 62 nt, Human
gugaugcuaugccugauccuccuuuccauaaacauuagggaagaacuuuuggcaaguguuau

SEQ ID NO: 4198003 - RNA, 98 nt, Human
gugaugcuuccagggugugccugggccuggacaaggccacuaggggacugcccuagccugacucuuugguccuaagguauccaucuguuuagcauuac

SEQ ID NO: 4198004 - RNA, 104 nt, Human
gugauggaggugguggagagacaggccagagguggggcagcccuccgccucaggguuccccauugcucccuggcuagucuccugcuuccuaugaccuuugucac

SEQ ID NO: 4198005 - RNA, 58 nt, Human
gugauggcagugggccucgaguccuuggaccaugagagaccagggccagcugugucau

SEQ ID NO: 4198006 - RNA, 73 nt, Human
gugauggggcuggcuuugaggguuggagaucacacacacacaaucagccagcucuccaaagcaagccccacac

SEQ ID NO: 4198007 - RNA, 70 nt, Human
gugaugguaucgcuggggcaaugucuacaaccaaauuuagaaaguuagaacauucacaggauauuaucau

SEQ ID NO: 4198008 - RNA, 76 nt, Human
gugauguaaaguccuuugaaggcaaaaggagacaugcauaugaucuuccaaaaugcuuucaaguuaguuacgucau

SEQ ID NO: 4198009 - RNA, 55 nt, Human
gugauguagcccuaauucugcagacacuugaauguaguuaguagaaaugcaucau

SEQ ID NO: 4198010 - RNA, 87 nt, Human
gugaugucauccaaauugcuucaugagguaguggcagugggauccauccuuguuugcacaugccagccucagcagcaguggcauuau

SEQ ID NO: 4198011 - RNA, 87 nt, Human
gugaugucugcuuuggaaauauagacucaaggcacauagaugaaauauuuuacugggauuuuaaauuuugaaagcaacaagcauuau

SEQ ID NO: 4198012 - RNA, 77 nt, Human
gugauuaaaucaacaguugcacuggagaggucagcgaggauuaucagagggacccugagugcaacggugaggauuau

SEQ ID NO: 4198013 - RNA, 84 nt, Human
gugauuaacugaucuggaguuagaguagacacugaacuagaaaaagucaucaauguauacucagcauuuagcuuaaguaguugc

SEQ ID NO: 4198014 - RNA, 70 nt, Human
gugauuaccuguggguggguugguuugagagggcuucucagagaaucaggacccacucuacaguuaacac

SEQ ID NO: 4198015 - RNA, 70 nt, Human
gugauuagcuguagugcuuggcauuuaacauacauucaggagauauuugcuggguaaauagcugaguaac

SEQ ID NO: 4198016 - RNA, 57 nt, Human
gugauucaaauguaacuaauuacuuuugagacugaguuuggaaguuauaugagucgc

SEQ ID NO: 4198017 - RNA, 59 nt, Human
gugauuccugggauaugagucuggggguguccucuguacccucagacauauuccaucau

SEQ ID NO: 4198018 - RNA, 82 nt, Human
gugauucgaguaguccagccauaucuuguagcccuucuuugaaugagaggguggcuggaguggucuggugcugggauaucac

SEQ ID NO: 4198019 - RNA, 98 nt, Human
gugauucuccuaccucagccucccgacuagcugggauuacaggcgcccugcgccacguccagcuaauuuucguauuuuuaguagaggugggguuucac

SEQ ID NO: 4198020 - RNA, 61 nt, Human
gugauucugaccuucagggaguuccagaauaaaguuagacuccuacauggccaugagucac

SEQ ID NO: 4198021 - RNA, 59 nt, Human
gugauucuguucuggugcugccccugggcggacccuacccagcacaaggacaggcucac

SEQ ID NO: 4198022 - RNA, 61 nt, Human
gugauugagucacaacaaauccagauuccuggaaucugugagaaaggcuugugcucaucac

SEQ ID NO: 4198023 - RNA, 86 nt, Human
gugauugcuuaaaaaguaacugcugauguauuuguaaauuauuuccaauuuaauuuugugauggcaguuacuuucuaagcuggcau

SEQ ID NO: 4198024 - RNA, 57 nt, Human
gugauugucucucauuccugcaacuccuaauggugcacaucagugagggcagagcac

SEQ ID NO: 4198025 - RNA, 94 nt, Human
gugauuugcauaauuuauucccgucucugggcucugauuggucacaccuugcugacgccggaaccgagacuggagaaaguuugaaugaaagcgc

SEQ ID NO: 4198026 - RNA, 81 nt, Human
gugauuuuagcucagugaaagugguuuugaauuucugcccucugaaaugguaagacaacacauuauguuguuauaagucac

SEQ ID NO: 4198027 - RNA, 82 nt, Human
gugcaaaaauuuguuuucaagucacuggacauaaggcaaugaaauauaaugaucccugagugauugaaaauaaaggaaguac

SEQ ID NO: 4198028 - RNA, 92 nt, Human
gugcaaaaugcuuaggacaguagcuggugcacaguaaacacucaacaucuguuagcuguugugaucauuacuauccucauuaucaucugcau

SEQ ID NO: 4198029 - RNA, 101 nt, Human
gugcaacaaggcugacaugugcugugcugucauguauuuaauuaguugugcauggagauugauacauguggcugucacagcauaauggacuggcauggcac

SEQ ID NO: 4198030 - RNA, 87 nt, Human
gugcaacagugucauuucaauuauuugcucuucuugggcuuaaaccauuaaauagcagaggggcguaaugagggguuuugagugcac

SEQ ID NO: 4198031 - RNA, 87 nt, Human
gugcaacuuaccaagcaacugccuucaauauuuaacggcuuucauaugaaagaggcuagaggaugcaggauuguuuguaaguuguac

SEQ ID NO: 4198032 - RNA, 85 nt, Human
gugcaagaggagauacuugguaggcaaagugugggucaccuggugguuuugaccucgaguucuuucaauucacucauccuugcau

SEQ ID NO: 4198033 - RNA, 66 nt, Human
gucucacagccucuggagguagugugaucucugcgaucucagcugaccccuacagguuguguuagc

SEQ ID NO: 4198034 - RNA, 66 nt, Human
gucucacagugcugaaagcccuucaagucucaauggucuauugaggaggccuuucagggcuugaac

SEQ ID NO: 4198035 - RNA, 56 nt, Human
gucucaccuuaaccaguguuuuuaccuuguaucuaaaugucauugaauggugagac

SEQ ID NO: 4198036 - RNA, 129 nt, Human
gucucacgaguauacaauggaguuuuccagaagggacaagacaugugaugacaucaucacucugaugacuguuggaaugcaugcuuguguacucccauguuuuggacacauccguuuuaauucuaagau

SEQ ID NO: 4198037 - RNA, 62 nt, Human
gucucagacuuucaggguaggccaaccuucaggauuagccuuuucuagaagugucuagggac

SEQ ID NO: 4198038 - RNA, 59 nt, Human
gucucagagagcuacucucuuacagagaauagugugcguagguuguagcucuaagagac

SEQ ID NO: 4198039 - RNA, 128 nt, Human
gucucagccagaaaacuguuggguggguuggcugugacagagcauguagugacagccccugugugggcgaggcugggggcaacuguaacugccacagcccagagccccucagcucucucccuagagau

SEQ ID NO: 4198040 - RNA, 60 nt, Human
gucucagccagaggcugcgaggggcccaacaggccgccaaaggugcuucuggccagagau

SEQ ID NO: 4198041 - RNA, 55 nt, Human
gucucagcgaaaggaguguggcuuucaauaaagagaucacauaauuuccugugac

SEQ ID NO: 4198042 - RNA, 73 nt, Human
gucucagcugaccuaaggucagaagucuagugauguuuagccagacauucuuucaccuuguguccagucugac

SEQ ID NO: 4198043 - RNA, 60 nt, Human
gucucagggacugcuucugggggaacucaaccuaagacagacugcaaaguccuccaagac

SEQ ID NO: 4198044 - RNA, 75 nt, Human
gucucaguuaccaucucuguagucaguaauguugagaugaagcaauguucacuguacuggugaugguuuugagau

SEQ ID NO: 4198045 - RNA, 72 nt, Human
gucucaguuguaucaccugguucugcuuuagccuuauucucaagaagguucuccccagguggugacagagau

SEQ ID NO: 4198046 - RNA, 59 nt, Human
gucucaguuuuccaaacugucaaacucuuuuuuaugacuguugggaagauaacugagac

SEQ ID NO: 4198047 - RNA, 72 nt, Human
gucucauacaagccauggaaaaaucuggugagcuaucucuucucucagaacacccuucuauggugaugggac

SEQ ID NO: 4198048 - RNA, 130 nt, Human
gucucaugguuuugcuguuacuauugucuuuaacuagcuuguacugcaguagagaaggcaauuagcuguguuuaucuuuguugguacacucugaucaaaacagucaaggaacagaugcuuccagguggac

SEQ ID NO: 4198049 - RNA, 80 nt, Human
gucucauugagugcugagcccacuuccuugcacacuccuccguggucccaggaaggauucggcauuucuaaacuggagac

SEQ ID NO: 4198050 - RNA, 56 nt, Human
gucuccagccauucucugaucaucucuguaugaacugaaaugagaaugcugagcac

SEQ ID NO: 4198051 - RNA, 84 nt, Human
gucuccagccuucucagcucagccccuuaucgaaaugcacuaagcaccaucuucaaaggcgcugggcuaaggcaccagggagac

SEQ ID NO: 4198052 - RNA, 73 nt, Human
gucuccccagucccgcaugguccagaaugagauccccuacuucaucuggaccacucggcgggaugugcucgac

SEQ ID NO: 4198053 - RNA, 119 nt, Human
gucucccccugcccagagaacauguucauuuuucuagcuguggaucaagaccaaguucagaggucagagaccuagcaagaaauuggaguguguuccagaucuucaaauagguggggaac

SEQ ID NO: 4198054 - RNA, 55 nt, Human
gugccaugugaucccagaauuaaacagcuaaugaaauucucugcucaaguggcac

SEQ ID NO: 4198055 - RNA, 58 nt, Human
gugccauuucacaggagcugaggguggagacaacagucuguuucuugugaagugacac

SEQ ID NO: 4198056 - RNA, 68 nt, Human
gugcccacaucugcugccuccugggccaguaguuccugguccugggcacaguauaugcccuuguccac

SEQ ID NO: 4198057 - RNA, 56 nt, Human
gugcccacguuggcuccuacagcagcaccgccugcugagaagaggguauguggcgc

SEQ ID NO: 4198058 - RNA, 75 nt, Human
gugcccacuugguaaagcacaauuucaccuucuuguaaaccacagggcagagugaaaugcuaugaaugugggcac

SEQ ID NO: 4198059 - RNA, 62 nt, Human
gugcccaggugucccugagaagucuaucucugcugcuacuuucucagggccgcagaggguac

SEQ ID NO: 4198060 - RNA, 106 nt, Human
gugcccaugucuuccacagagaacagggccuggggacaccaccaugacaucucucugaggguuggucugcaucauggugguucccaaguuuguuuuccaugggcac

SEQ ID NO: 4198061 - RNA, 81 nt, Human
gugccccaugggcuccaggagcccuaagagaguccuuuucacuauugugacuucuugcugggccuggggcaccuggaacac

SEQ ID NO: 4198062 - RNA, 64 nt, Human
gugccccuuucugggaccccugucuccuuccagaaaguacgagacccucccagaagggggcuac

SEQ ID NO: 4198063 - RNA, 74 nt, Human
gugcccugccagugccucccacuggucacauccaacaugaagccagccacaagggaggcuugugcaggcugcac

SEQ ID NO: 4198064 - RNA, 63 nt, Human
gugcccuggcucacagugucucugaaaugguauuauuguagugggauaauugugauuagggac

SEQ ID NO: 4198065 - RNA, 55 nt, Human
gugcccugggaacacagaugccacugaaaaacuuguggucaaguucucagagcau

SEQ ID NO: 4198066 - RNA, 55 nt, Human
gugcccugucucuugucuccagucaucugccugacuuggcugcagugacaggcau

SEQ ID NO: 4198067 - RNA, 99 nt, Human
gugcccuguuucugguuccagauacccuuacacuuccugcacuuuccaaggcacacacacagugggcugcaggggggucuggacuuggagcaggagcac

SEQ ID NO: 4198068 - RNA, 91 nt, Human
gugcccuuucaaggcaacugacagcuggagcccuauggcugguggaggcagacacagggcaggggcucucagcuggccaggaagagggcac

SEQ ID NO: 4198069 - RNA, 68 nt, Human
gugccgacacuggguaaccaacuauucaggcuuuggccacagaagccugguuuugcccagucuugcac

SEQ ID NO: 4198070 - RNA, 59 nt, Human
gugccgcgacgcagucggugcccguguaucccggcaggcgcagagcgaacuugcggcgc

SEQ ID NO: 4198071 - RNA, 77 nt, Human
gugccuacaguuaugaauggagcucuuuguuaccuuccagaucgacaagacagacuguuugguucaugucugugcac

SEQ ID NO: 4198072 - RNA, 70 nt, Human
gugccuacaugugcuggguucuuggccaggcugcagugugucauggugaacaggugggugugguaagcac

SEQ ID NO: 4198073 - RNA, 87 nt, Human
gugccuagcaccagcuggaugcugggaguucagcaugcagagccuuggccucuguccuccggagcucccagucuagcaggcagacac

SEQ ID NO: 4198074 - RNA, 76 nt, Human
gugccucccagccccacaugagcugucucguagggccaagacagcacuuuuguaugggggucuguuucagaggcac

SEQ ID NO: 4198075 - RNA, 89 nt, Human
gugccucugaguccuuggacucaugaucacuucgggguuuccuaaaggcaauuuugugcagugguuaagaccaugggcucuggaggcac

SEQ ID NO: 4198076 - RNA, 90 nt, Human
gugccugaaguauauucauuugacagacauuuacuacauuauuacuacuuuaaaaauacuguucugcaugcugugagggaauacagacac

SEQ ID NO: 4198077 - RNA, 64 nt, Human
gugccugaauucauuuacaacuguugcugcuuuaaacacuucaggcagaauaaguggauggcac

SEQ ID NO: 4198078 - RNA, 61 nt, Human
gugccugcagcaauccauggcacagaccagcuguugguagcugccaggaugcugcacgcac

SEQ ID NO: 4198079 - RNA, 67 nt, Human
gugccugccaucagaaacacucaaagcccucucguuuggguuuugaaauggacucugguggagaugc

SEQ ID NO: 4198080 - RNA, 63 nt, Human
gugccugccucaucaacuugucguguggauuaaacgugauaauccuuguggggcguuuagcac

SEQ ID NO: 4198081 - RNA, 62 nt, Human
gugccugcucagagcccaggguacacccguucuugggagcgggcagggcugugggcaggugc

SEQ ID NO: 4198082 - RNA, 63 nt, Human
gugccugcucugugccacaguugggagcaaaacagacauggccucggggcucagagagugcac

SEQ ID NO: 4198083 - RNA, 65 nt, Human
gugccugggguugagcuaugaagcagaucuuauuguuccuuuuuagcuccccagccccacaguau

SEQ ID NO: 4198084 - RNA, 84 nt, Human
gugccuuacgccgacacucagggcucccucuggcucccaggucacuccuguggccccagagggcgguccgugcggucauggccc

SEQ ID NO: 4198085 - RNA, 71 nt, Human
gugccuuauaguggaugaacuccaaaccaacauauaagaugcuuggucuguguuacaucauuuaaaggugc

SEQ ID NO: 4198086 - RNA, 75 nt, Human
gugccuuccuucuugcuacugcuguugacuccucuauuaguuggagacaagagccuuugggcagaaggaugguac

SEQ ID NO: 4198087 - RNA, 88 nt, Human
gugccuuugaugguaucaaugaauuacuguaaaauaguucuguuaaaagaaaagaacuuccaugugauucuuugaucuaugaaagcau

SEQ ID NO: 4198088 - RNA, 69 nt, Human
gugccuuugugucuaaaacagccaugcuacaaauuagcacugacuugccuuuauuaggcacagggguac

SEQ ID NO: 4198089 - RNA, 91 nt, Human
gugcgcucucagagucccacugagcauaugcagaugaggccugucuguaugcaaaugagcccgucuguaugcagaugaggagagagggcau

SEQ ID NO: 4198090 - RNA, 128 nt, Human
gugcggugagagcagagggggcuccaucccgccccagcuccaggcagcauuaauaaaaugcagguguuuuguguauguauagcugcuugagggaggagggagaaagagccuugacugcagcagcgcau

SEQ ID NO: 4198091 - RNA, 60 nt, Human
gugcgucaucgggcugcagaugggcacccacaaaugcaccagccagucccgcaugaccgc

SEQ ID NO: 4198092 - RNA, 125 nt, Human
gugcgugugcugcuccuuguggugccugaggagagguggccuguguugcauucacagaaaucaugacacacaagacacgagcggccucucuucaguaucagaucccaccugcaugauuccugcac

SEQ ID NO: 4198093 - RNA, 74 nt, Human
gugcuaaaucaugugcagagaucaggagcuaugaggagggagcucugagaaggaagcucuguguacagaagcac

SEQ ID NO: 4198094 - RNA, 58 nt, Human
gugcuagagcugggugguggugacucacuuacaugaggcauuugcuucccaguuucac

SEQ ID NO: 4198095 - RNA, 129 nt, Human
gugcuagcacagggcugacgcugacgggcagucuucuagugcuugagucucuccguaccccugagggaggggugugcucugaccaggaacgagaucagacagcugugagagucccgaccagggcugagc

SEQ ID NO: 4198096 - RNA, 93 nt, Human
gugcuagcaggucucccaauaugcagaugcugccuuguugagucaaagaacauuccaaguagaagcauuugcauucuggggacuagcuucuau

SEQ ID NO: 4198097 - RNA, 67 nt, Human
gugcuauagguccuagguggcaguuucaggucagguaugaccaucuccucugggccuauuuguucac

SEQ ID NO: 4198098 - RNA, 57 nt, Human
gugcucaauuacuguauggauuccacgaguugaugagcgugcugugaccuugagcau

SEQ ID NO: 4198099 - RNA, 64 nt, Human
gugcucacaauuucuucagccacuccaaacuggggccuuggggguccuggggguggcugggcac

SEQ ID NO: 4198100 - RNA, 63 nt, Human
gugcuccagguaggagagagggauccugagucagacaggauccccauccccaucugacugcac

SEQ ID NO: 4198101 - RNA, 57 nt, Human
gugcuccauggccuguguccaucauggggaucauugcccuggcacuuccuggagcac

SEQ ID NO: 4198102 - RNA, 102 nt, Human
gugcuccuggcauccccuccuggagcauuggugaggaaauuauuguacagaaauccgcacugugcucucagugagucugggugugagauaccaucaggagac

SEQ ID NO: 4198103 - RNA, 56 nt, Human
gugcucuauguugauuccuugaugcagugcuuaaggcuuuggucaccauggagcac

SEQ ID NO: 4198104 - RNA, 78 nt, Human
gugcucugaguccuggagaaacgcaggugccugcagcauugagcgcaacgcagguguguuuucaggacuaaugaauac

SEQ ID NO: 4198105 - RNA, 57 nt, Human
gugcucuugggggacucccugggggccaccucgguccucagaaguuuccuggagcau

SEQ ID NO: 4198106 - RNA, 64 nt, Human
gugcucuuggggguguauguuuacuuaaaaugcaaugagucagccuuggcagccccuucaccac

SEQ ID NO: 4198107 - RNA, 71 nt, Human
gucuuaccaaaguguuaugcaaaacucuguuuuguuuacugaaaagaguuuccauugacauuuccuaggau

SEQ ID NO: 4198108 - RNA, 88 nt, Human
gucuuagagccuacccagcaccuaggcugccuuuacuaucucugcaggucagacacagugcugggugcugaguccugucucucaaugc

SEQ ID NO: 4198109 - RNA, 84 nt, Human
gguuauggcaaauggccuuugagaugaaagggaggccgaggccggcaguucauuuagaacaggaguggccaucugucaauagcu

SEQ ID NO: 4198110 - RNA, 117 nt, Human
gguuaugucuuugcacuggucuugguaucagaaacuugaacccagcucaggcuuugcuaauaaagagcuguaagcuuugggcaagucaucuuacuuuccauuguuucagauuuauuc

SEQ ID NO: 4198111 - RNA, 77 nt, Human
gguuauuaguuaagagagcaaaaucuggggauagucugucuuguucaaaucccaucugcauuucuaacuaguugacc

SEQ ID NO: 4198112 - RNA, 105 nt, Human
gguuauuggagcaccuucuguacaccaggggccauucuggaugcugagaauagagccaccaacacagcaaacaaggucccugcugucagggaguucacaguuucc

SEQ ID NO: 4198113 - RNA, 57 nt, Human
gguuauuguuaccuuugugucagauuuguuacuuccuuaacaaaggucugcaagacc

SEQ ID NO: 4198114 - RNA, 82 nt, Human
gguuauuguucuauggugaggcagccacagcgucacucuugagcuuucugcaugccugccucccauaccaaacauuacagcc

SEQ ID NO: 4198115 - RNA, 77 nt, Human
gguucaagaaaggucauugauuuucaguuuguccaacuuuuauuuguuggaaggacuggagugaugacucucaagcu

SEQ ID NO: 4198116 - RNA, 83 nt, Human
gguucaaggcccuguucaaguguuaccucuccugugaagcucccuucccuggggaaggugaccuuucgcugccuucugacucc

SEQ ID NO: 4198117 - RNA, 56 nt, Human
gguucacuccgaucucugccucccucugacgaggcccucugcgauuccaguggacc

SEQ ID NO: 4198118 - RNA, 73 nt, Human
gguucagaauagggcaggugaagaaaagcuauguuuauuuuacccauaguuucaagccuucucuguauugauc

SEQ ID NO: 4198119 - RNA, 75 nt, Human
gguucagaggccugagcaggugagucuagggcagagcacagcagcugucccucaucaccucugggucucugggcc

SEQ ID NO: 4198120 - RNA, 70 nt, Human
gguucagagguaagaggcuugagaauauucuguuauggggaaagcagugaagcuuccaaacugcuggacu

SEQ ID NO: 4198121 - RNA, 129 nt, Human
gguucagaguuugagcucuggggucaggcggagccgaguucagccuuggcacauuccccugcaccagcccgugcccuggggugaaccccugggcucccuuggccucuucucagcuccucacuguguccc

SEQ ID NO: 4198122 - RNA, 60 nt, Human
gguucagcagcauuuaaggauccaagucucuuggauuuggugguuuggauguguguaacc

SEQ ID NO: 4198123 - RNA, 85 nt, Human
gguucaggugugaguuuguuuuagagagaauauggggaggaagauaaaaaagguccuuauucauaagucagacacaccuaguacu

SEQ ID NO: 4198124 - RNA, 72 nt, Human
gguucauauuugaagggagaaagugccauguuuuauauacaucauuuucucuucuuuaaauccagugaaauc

SEQ ID NO: 4198125 - RNA, 79 nt, Human
gguucauccauauugcagcaugugucagaaauuccuguauuuuaaaaggcugaauaauuuucuguuguauggauguacc

SEQ ID NO: 4198126 - RNA, 58 nt, Human
gguucauggaaggcaaaagacacagauggggauauuaauacucuggccuuccugaacu

SEQ ID NO: 4198127 - RNA, 91 nt, Human
gguuccaagcauuucagguagagauauucacccuguagaacgcuuugauucugaagaacauaugauauacaaauccugagauucuggggcu

SEQ ID NO: 4198128 - RNA, 82 nt, Human
gguuccaagucuuugcuauugugaauagugccacaauaaacauaugugugccugugucuuuauagcagaaugauuuauaauc

SEQ ID NO: 4198129 - RNA, 82 nt, Human
gguuccaagucuuugcuauugugaauagugccacaguaaacauaugugugcaugugucuuuauagcagcaugauuuauaauc

SEQ ID NO: 4198130 - RNA, 82 nt, Human
gguuccaagucuuugcuauugugaguagugccacaauaaacauaugugugcaugugucuuuauagcagcaugauuuagaauc

SEQ ID NO: 4198131 - RNA, 59 nt, Human
gguuccagaauuuuguucugcuuguuaaguaauaggcauuccccaaaauuucugcuacu

SEQ ID NO: 4198132 - RNA, 84 nt, Human
gguuccagcagcucaggcugcuucccauugguucucacacagugugcuucucuggguagagcaggcuggggcuucaguugaacc

SEQ ID NO: 4198133 - RNA, 62 nt, Human
gguuccaggaggccucauuuccuguauguuagaagaauaaauaguaaaauguguccuggacc

SEQ ID NO: 4198134 - RNA, 58 nt, Human
gguucccaccacccaggcagagaucaaagaugcaaucuuucaagggacccuggggauc

SEQ ID NO: 4198135 - RNA, 107 nt, Human
gguucccaggugauaugugcuccuggucuuccaugaggaguucaugaggugagcuugaugaggccuaucuuggcagagggaaugguacaugcaaagcucuggaaauc

SEQ ID NO: 4198136 - RNA, 76 nt, Human
gguucccauguuacuaguggagaaacugaggcucagcuacuuggccagggaucgcacagugagaugggcaaggacc

SEQ ID NO: 4198137 - RNA, 61 nt, Human
gguucccggaucuccgagucccacuccaccagcuucuggggcggcaugggguccggggacc

SEQ ID NO: 4198138 - RNA, 58 nt, Human
gguucccucaggcucagguuaggggccaagugcuugcgcuuggcgagcuguggggacc

SEQ ID NO: 4198139 - RNA, 61 nt, Human
gguuccugugccucuagcuggccgggccacaagcauuucuccagcugcuggcccagggacc

SEQ ID NO: 4198140 - RNA, 67 nt, Human
gguuccuguguuacugccuggagcggagcugccuguccugcaacaggcugugacauggaagagaacc

SEQ ID NO: 4198141 - RNA, 83 nt, Human
gguuccuuacugugcuauggagaaauuuguuaccuaaguuuuacccaccaguaauaaguuucuccaaagcacagaaaggaauc

SEQ ID NO: 4198142 - RNA, 62 nt, Human
gguuccuuguuuguagcucugggagccauccugggggcucccucgcuagaaggccgggaacu

SEQ ID NO: 4198143 - RNA, 73 nt, Human
gguuccuuuagguuuuauuuucucaaguguuuauuacauuucacagaaagagaaacuaacaucugaaggugcc

SEQ ID NO: 4198144 - RNA, 86 nt, Human
gguuccuuuuaguggaauccagaguuuaauugcuggaaucuggguaagguuuaguguuucaagacucuuucccuaagacuagagcc

SEQ ID NO: 4198145 - RNA, 101 nt, Human
gguuccuuuuuguuucuuugaaguggaaaaggauuuaaacuauuuuuacgcuccucaguuuaauuguuuucccaacuuuacagaaguuagaaacauacacc

SEQ ID NO: 4198146 - RNA, 64 nt, Human
gguucgggggccccugcggucuccuggauggcagaccagugaggcagcaggagccucugugucc

SEQ ID NO: 4198147 - RNA, 55 nt, Human
gguucuaggucuggggauaaugauguuauccuucauuaucugagaucaugauacc

SEQ ID NO: 4198148 - RNA, 66 nt, Human
gguucuaguuaaaaugcaaauaugcuaccugagacaaguagcagcuaugccauuuugacaugaauc

SEQ ID NO: 4198149 - RNA, 70 nt, Human
gguucuauggcaauugucuaaguuuuaccacuugggagauaauuuagagcuuaguaauuuuuauauggcc

SEQ ID NO: 4198150 - RNA, 65 nt, Human
gguucucagugaauuggaggauggccacccaagugagggaggccauuugcuuuauucacuucacc

SEQ ID NO: 4198151 - RNA, 84 nt, Human
gguucucucaucccuugauuuguuucaaguuagcaucucauuagugaugagugcagaaccaaauagugucaggcagagagaauc

SEQ ID NO: 4198152 - RNA, 120 nt, Human
gguucuuccuuguucaccaguguccgggacauguuggucaaggcuuuuguucgaauagaggaagggagagcaggagcuguguaugcaucauucugaaccacuuuggugagagggagggcc

SEQ ID NO: 4198153 - RNA, 62 nt, Human
gguucuuccuuuacuagccuccacaugaaagaguuaccuaugucucagaggcaggaagagcc

SEQ ID NO: 4198154 - RNA, 82 nt, Human
gguucuugguuucagggaaaacaucccgccuaacccacccagguuaggccccuucccugaagccucccaguccccaagagcc

SEQ ID NO: 4198155 - RNA, 63 nt, Human
gguucuuguuucaagcucugcuuuuggaaaaaccugaagacagagacucugcaacagggaacc

SEQ ID NO: 4198156 - RNA, 56 nt, Human
gguucuuugcuuaaugauucuuuuaagaaagaaaagaaucaguaaguaaggagacc

SEQ ID NO: 4198157 - RNA, 67 nt, Human
gguugaaaaugacuuuauaccaugagaggaccuuucagcuuaaaaaaugguaugaaguugaacaauc

SEQ ID NO: 4198158 - RNA, 97 nt, Human
gguugaacauuguuuaaugguuagauguuaugugugucugcauuuaaaaaaauuguguacauguuauuucacuauugguauuacaauauucauaacc

SEQ ID NO: 4198159 - RNA, 64 nt, Human
gguugaagagaagcauauaugugauguaugaaugaaugaaagcaguguuugcuucaucuuaucc

SEQ ID NO: 4198160 - RNA, 74 nt, Human
gguugaauaaugaggauuggcaaaacucagggaugugcucaccucccuagauuaugaaaucccauugucuaauc

SEQ ID NO: 4198161 - RNA, 68 nt, Human
gguugacagcugugggcucugcauauaugacacacaguggguuauguccaguucuuacugcugugacu

SEQ ID NO: 4198162 - RNA, 69 nt, Human
gguugagagcgcggcucugccagugacuaguguggaauaacagucaccaggguuugcuggguucucacc

SEQ ID NO: 4198163 - RNA, 77 nt, Human
gguugaggaccagguugguguccuucuggccacgcucaguggccagguugcugacgacgaucugguaguucuccauc

SEQ ID NO: 4198164 - RNA, 81 nt, Human
gguugaggcucagcgagguguuguugcuguccuggggucaucaugauccacagugggcacagcaggacucuggcuucagcc

SEQ ID NO: 4198165 - RNA, 77 nt, Human
gguugagggaagguagaggucaccggcacauaguucauuugcaaauauaugcugaugacaucuaucuucccucaacc

SEQ ID NO: 4198166 - RNA, 74 nt, Human
gguugaugcaaaaguaacugugauuuuuggcauugaaaguaagggaaaagaucacaauuacacuugcaccaacc

SEQ ID NO: 4198167 - RNA, 58 nt, Human
gguugauucucauuaucuuggggugccuucugcacuucugucuguaaugggauuuuuc

SEQ ID NO: 4198168 - RNA, 69 nt, Human
gguugauucuugggccuucugaaguucggggcacaugcaggcgagcauuacagauccuaagaauaaauc

SEQ ID NO: 4198169 - RNA, 75 nt, Human
gguugauuugggauagguuuguguuugagaacauauuuguuuauguuuuauuaccaacuuguacuuaaauauacu

SEQ ID NO: 4198170 - RNA, 64 nt, Human
gguugcagucaugugaauaagugugggguuacguugacucgacaaauauuuauugaauguuucc

SEQ ID NO: 4198171 - RNA, 70 nt, Human
gguugccccucuccuugcagauggcugccuaauccuccaggagccauuuuccaagggcgagauggcgagc

SEQ ID NO: 4198172 - RNA, 91 nt, Human
gguugccuaagauagcuguaugaagaaguucugugaaaugauauguacugcuucguugcauagcauuuuuauaaucuucugacuggcaacu

SEQ ID NO: 4198173 - RNA, 83 nt, Human
gguugcuccaaacuugucuaucuaggaaucauguacugcaaagcuaugaagauaccucagaggaucuaagugugggagcuucc

SEQ ID NO: 4198174 - RNA, 68 nt, Human
gguugcugaagccaggccacgcucccugccccagcagguccaggcugagcugaccugguuuggcugcu

SEQ ID NO: 4198175 - RNA, 59 nt, Human
gguugcuuccaccucuuagcuauugugaacaaugcugcuaagaaccuggguacgcaacu

SEQ ID NO: 4198176 - RNA, 61 nt, Human
gguugcuugcagaacagacagacaaccccauggugaguuucucaguucucugcaaggaguc

SEQ ID NO: 4198177 - RNA, 77 nt, Human
gguuggagaucucaucuauggccacuuugugguugcuaauaaagacauggaacuagagaugguguguauugacagcu

SEQ ID NO: 4198178 - RNA, 77 nt, Human
gugcuucccuucaaaacacuaguuuuugagcacuucuacaucagcagcucaaaauguaauguucugaaaccuggcac

SEQ ID NO: 4198179 - RNA, 55 nt, Human
gugcuucuccguucugcagcacuuggcugaggugccagcagggaaugggaaggac

SEQ ID NO: 4198180 - RNA, 130 nt, Human
gugcuugagacuagaggcuuguaauucagguccaucuuguucccauagugaccgaugcugaccucgaaauggaucagcucuuuaaaguugggcaucaugguacaggaaaggaagaugacgcacagcccau

SEQ ID NO: 4198181 - RNA, 56 nt, Human
guaggaacaaaacuggcugacugcagauggugcaaccaguccacuggaguuccuac

SEQ ID NO: 4198182 - RNA, 60 nt, Human
guaggaagcugagcagcauuccuggccuccauccacaagauaccuguagcaguguccugc

SEQ ID NO: 4198183 - RNA, 55 nt, Human
guaggaauuggcuuuggauguguaaaaucacaaauaaccacagcagaguucuuac

SEQ ID NO: 4198184 - RNA, 58 nt, Human
guaggacagcccuugagagcacauuuaucccaauggcuuuugguguguugucagaugc

SEQ ID NO: 4198185 - RNA, 65 nt, Human
guaggacuggauauugaguacugcaauguucaaugacguugcaacucugagguccauacuucuac

SEQ ID NO: 4198186 - RNA, 60 nt, Human
guaggagccauccccaugagagguaagccauggaggcgauaccuggggaaagguaccugc

SEQ ID NO: 4198187 - RNA, 61 nt, Human
guaggaguguucgggaacuggggagcagugcaguuuguuagauccuuccaacuacucuuac

SEQ ID NO: 4198188 - RNA, 78 nt, Human
guaggaguuugaggucuucaugaguugcccgauucaugcucccaugcugguauuuggugaugccuccaaacuauuuac

SEQ ID NO: 4198189 - RNA, 88 nt, Human
guaggauccagugauguuucugcaucagagugaaggaauuucuaaaugagagcaaacucucugccaugcauugacaucgggguucuau

SEQ ID NO: 4198190 - RNA, 67 nt, Human
guaggcacaucuauagggacagcaacaccgagagguaacuguuuuuaaauagaugaguguugccaac

SEQ ID NO: 4198191 - RNA, 57 nt, Human
gugguaugcuuugaagaauuucucuguuguaaaauaucuuccuccacagcgugccac

SEQ ID NO: 4198192 - RNA, 61 nt, Human
guggucacacucucugcaggggcacugggcccagccucugugggaagcugggugugagcgc

SEQ ID NO: 4198193 - RNA, 56 nt, Human
gugguccaaggaguuuccagcacucagcugcagagggaagcuuccuuggugaucac

SEQ ID NO: 4198194 - RNA, 60 nt, Human
guggucguggguguuucccaugugccuuucaugggauccuucuuugaccucacagacggc

SEQ ID NO: 4198195 - RNA, 66 nt, Human
guggucugggucucuuaccaugugacugguaaggcaucagucacaugggauuagaacccauccuau

SEQ ID NO: 4198196 - RNA, 63 nt, Human
guggucugugaaaaggaagcucauuauagguuuuaugugaugagucaccacaguuacagucac

SEQ ID NO: 4198197 - RNA, 83 nt, Human
guggucuucaguugucauacugccuuggugacaaucuuucaauuucaauucaguaaguucagcaauauggauugaagacacac

SEQ ID NO: 4198198 - RNA, 104 nt, Human
guggugaaugggcagucaaguggaugcagagauuguuuuucaacauuacugaaucaugacagagucugccauccuaaaucuuggcuaagauuccuuuacaucac

SEQ ID NO: 4198199 - RNA, 99 nt, Human
guggugaccagcuucagagugggaagcuacucaugcaggcagagggacuuccuuuauuuucauauguguuucucucuuuggaguuuugugggucaaaac

SEQ ID NO: 4198200 - RNA, 57 nt, Human
guggugacccuucaggucucaguacuuuuccaaggagcugggauacaggcuuacugc

SEQ ID NO: 4198201 - RNA, 56 nt, Human
guggugagacgagcuccaugucuuauguaguauucauauauaugugucucaucuac

SEQ ID NO: 4198202 - RNA, 73 nt, Human
guggugauuuauaguaugugcuuucagauucgcccuacuuuaaucaugaaagcuucauucuauagaccaccac

SEQ ID NO: 4198203 - RNA, 56 nt, Human
guggugcaauguguguguguguguguguguguacacacacaagcagguuguggaac

SEQ ID NO: 4198204 - RNA, 70 nt, Human
guggugcuggcaggaauaaauuauggacuuaugaauauaacauaagauucuuuauuaccuggucucaccc

SEQ ID NO: 4198205 - RNA, 60 nt, Human
guggugggacucuucuuuggcagugccaucaucauguacauggcccccaagucccgccau

SEQ ID NO: 4198206 - RNA, 64 nt, Human
gugguggggagagaccggaauguuucccaggaagccacaacccugggggacgcucuccagccac

SEQ ID NO: 4198207 - RNA, 90 nt, Human
guggugggugucaccaauaauaacuugagaauugagaaguacauauucucgcuucacucguuuucaugccuauuuuuggacauccaccau

SEQ ID NO: 4198208 - RNA, 101 nt, Human
guggugguaugcaccuguggucccagcuacucuagaggcugaggcaggaagacugcuugagccugggagauggaggcugcagugagcugugaucacaccac

SEQ ID NO: 4198209 - RNA, 73 nt, Human
gugguggucuauagaaugaagcuuucaugauuaaaguagggcgaaucugaaagcacauacuauaaaucaccac

SEQ ID NO: 4198210 - RNA, 112 nt, Human
gugguggugcuuccaccagucccagccuguguguuuagcucuggggcugguguuaugcaacauguuccaugcuaagacacgcagggggcauucuggggagacacacacacac

SEQ ID NO: 4198211 - RNA, 76 nt, Human
guggugguggcuugaccaggauugaggggcugaagccuucuucgcggccaguccugcucccugaccaccagaccac

SEQ ID NO: 4198212 - RNA, 92 nt, Human
gugguguauuuaauuuggaccaguuuauucauuuuaaguuguuguugaacaaacacacaaaguaggcagugggcuggaaauggggacauugc

SEQ ID NO: 4198213 - RNA, 98 nt, Human
guggugugugagaucgacuucuguuaacuuguaagaguugauggugugcaucuuuuuuuacacuuagcauugagcgaaaucacauugaaaucagccau

SEQ ID NO: 4198214 - RNA, 91 nt, Human
gugguguucacucaaaauucuuuccauuuuguguguguuuaaaauuuuuuuaugcuaauacuuuggaaagaauguaggacauuggaccugc

SEQ ID NO: 4198215 - RNA, 78 nt, Human
gugguuaaugacacaguaauguguuucaucugauaauggauuaggucagaugaauacaguuuugugaguucuaaugau

SEQ ID NO: 4198216 - RNA, 69 nt, Human
gugguuauaccuggguagugcauggaacgcuuaaaaauaaguuucuaccgguacauucagggcaacuac

SEQ ID NO: 4198217 - RNA, 66 nt, Human
gugguuaucagagcuauuuugggaaguggcuuguuuccagccuccuggccuugcuccugaugccac

SEQ ID NO: 4198218 - RNA, 78 nt, Human
gugguucucuuccuccugacugagagcucuagccuucacauccguguuccagucagcaggauggaggaagagaaaugc

SEQ ID NO: 4198219 - RNA, 87 nt, Human
gugguugaagugaguaaccuagacugacauauguguauguaauacguacaugugcacauaaaacaguacuagcuaucuuuucucuau

SEQ ID NO: 4198220 - RNA, 78 nt, Human
gugguugcauuccugccacaggccacuguggcccucuuguuggcggguccaguaguugguggccguggagagcaccau

SEQ ID NO: 4198221 - RNA, 81 nt, Human
gugguuguccaggugcagccagucugccacacgguggcagugcuguuccacacuaggcaggcuugguggcaccgguuccac

SEQ ID NO: 4198222 - RNA, 81 nt, Human
gugguuucucaaaccucuuaauggccuguaaucuuucaacaguuaagaguauugcuaauaagagauuugagaacaauuugc

SEQ ID NO: 4198223 - RNA, 65 nt, Human
gugguuucuccugaguuccacgcuacacaugacagcaaccaacguggugauggucuucagacuac

SEQ ID NO: 4198224 - RNA, 98 nt, Human
gugguuuguaugaugugaagacaugguugagaauaaagugaugguuccccaccugccacccgguuuuccaaugcauaguuaauacaccgacaugccac

SEQ ID NO: 4198225 - RNA, 57 nt, Human
gugguuugugcauagcuccuaucaugacagaaauggguggagcuuaauauguaccac

SEQ ID NO: 4198226 - RNA, 60 nt, Human
gugguuuguuuuauuccuggaaggacuacuucacuguaaagggacaaaacacaaugccac

SEQ ID NO: 4198227 - RNA, 74 nt, Human
gugguuuuccucucuggacaucacauggcugcuuuuucugucauccaaaucucagacauguuguccaugaccac

SEQ ID NO: 4198228 - RNA, 56 nt, Human
gugguuuucuccaacccagaacucugcaagaaguaaagcuugggagagaaagguau

SEQ ID NO: 4198229 - RNA, 83 nt, Human
guguaaaaacuugucacuugcugaaaucaugggaaauaauuuuccuaagauagaagauagugaaaauuaugaguaauuuacac

SEQ ID NO: 4198230 - RNA, 67 nt, Human
guguaaaaauuccagagcuuuguuccucacuggccacaagggagguuaggcacuggauuucuuauau

SEQ ID NO: 4198231 - RNA, 93 nt, Human
guguaaaauaacucuuugagauagugauuuuauuuuguuuggauauauacccaggaugagauugcuguguuguauaggaguucuauuuuucau

SEQ ID NO: 4198232 - RNA, 69 nt, Human
guguaaaguacauacaugaacucauucacuugacaaauauugugagucgugcacuuguauacuuggcac

SEQ ID NO: 4198233 - RNA, 65 nt, Human
guguaaauaauucaacugucuuuagugcaccugucaggaaaaugaggaaggcuugaaguuuacau

SEQ ID NO: 4198234 - RNA, 55 nt, Human
guguaaaucagcuuguguaauaauuguggcacccacgcgcgcaagcagacuuacc

SEQ ID NO: 4198235 - RNA, 58 nt, Human
guguaacuuuuauucaugcucuggguucuccagcagcuuguuaaaaaguuccagacac

SEQ ID NO: 4198236 - RNA, 56 nt, Human
guguaaggccccagguucuuuaccugugaaaugggauuaacgauggcuccuugcgc

SEQ ID NO: 4198237 - RNA, 88 nt, Human
guguacaaaucuggaggcuugaggggagacagaguggacuccggcauuuuccgaguccuacauuucuuccucuggccugggaguacgc

SEQ ID NO: 4198238 - RNA, 83 nt, Human
guguacaccccucugugauaugguuuguaauauccaggggguuagagggugauauugcuccccauaucgcaguggggguacac

SEQ ID NO: 4198239 - RNA, 86 nt, Human
guguacauugauaaaggguugacaguuauuuccaaagcugcaaagugcuauaggaaguaauuguugccuggcuauucagaaggcac

SEQ ID NO: 4198240 - RNA, 59 nt, Human
guguaccuggaaucacagaggcugaguucaaaggucagccucucugaguccagacccgc

SEQ ID NO: 4198241 - RNA, 96 nt, Human
guguaccuuguugcugaaaaaugagugaauugugauuuguggacauauucuacaucauaauaauacuuagaaaguuuauaagcaaaguugguacac

SEQ ID NO: 4198242 - RNA, 109 nt, Human
guguacuaaagaucuuagagaucuuuugugugguaacucuuugcccuuucagcugaugaauaacugaagaugugcaauacaaagaaauuacuaaaagagaacugugcac

SEQ ID NO: 4198243 - RNA, 96 nt, Human
guguacugcagaggcuggacaauuaaaacugugcuucccaaaugcccuugcacugaggguucuggaugugagcguaguucggccauucagauacac

SEQ ID NO: 4198244 - RNA, 86 nt, Human
guguacugcuuuuuuguugcauucauggcauaaauuuuguggacgcauuucuacaaaaaccguggauucagcauguugcagaguac

SEQ ID NO: 4198245 - RNA, 80 nt, Human
guguaggauaguuuuuucugagcaguagaggugaaaugggaucuugucugugucggauaaaacuaagagguccauuacau

SEQ ID NO: 4198246 - RNA, 111 nt, Human
guguagggagugaaaggugaggaagcagcuguuugguuuagugacuuugcagucaugcaaaggcacagaagggaaaccaaacagauuuccuuaaccuuucagucccuagac

SEQ ID NO: 4198247 - RNA, 105 nt, Human
guguagggcauggguguggggucucuggcugcucugggucugcccagcugcccuuggagcuaaagggauaucagagcagcuguuaacccuuucccuguuuuaaac

SEQ ID NO: 4198248 - RNA, 73 nt, Human
guguauaaucucucaugcaaaauuuaguucuuuguuucucagcuuaaacuggauuuugaugagcaguuuucac

SEQ ID NO: 4198249 - RNA, 83 nt, Human
guguauauauguuuauaguaugugcauaugugugcaugugagagcauguacauauacuggcauacaugugcauauuaauauac

SEQ ID NO: 4198250 - RNA, 94 nt, Human
guguaucaauucaauuuuucuuaauccuuuuuauucugugugccaucuagucuucauacagagagcugugauugaguuaauuugauugauaugc

SEQ ID NO: 4198251 - RNA, 58 nt, Human
guguaugcccaucuuuggaagcuggauggaaacagaucccugaggugaggggcaucau

SEQ ID NO: 4198252 - RNA, 101 nt, Human
guguauguaugcauguuauugaugccugaggcuuguggaacucaucugccuggucuauuccuugagagcaacacgcaguaguauacgagcguaacaagaac

SEQ ID NO: 4198253 - RNA, 59 nt, Human
guguaugucugaguaauaaugugugugugggugcaugcaucuaugacuuagacauucau

SEQ ID NO: 4198254 - RNA, 129 nt, Human
guguauguguguguguguguguguguguuugguggggagggcaggggucuugcacgguggcugcccuuguacaccggcccuggcugcaccuuuccccacccucugcuucccaccagccuccucaugcau

SEQ ID NO: 4198255 - RNA, 70 nt, Human
gugucaggcugcuguccacaaagcauccacaagggcaucacccaggagcuuguuggaagcgccggaucgc

SEQ ID NO: 4198256 - RNA, 55 nt, Human
gugucaggggcagccaggaaauguucuguuaagauguccuuucuguuccugagau

SEQ ID NO: 4198257 - RNA, 121 nt, Human
gugucagucaggguucuuuguugcaagcaucagacacugacucuuguuaacuucagcaaaagagagaucugcuggcagaauaucaggaagcucaguuguuugcggagaagccugaagacgc

SEQ ID NO: 4198258 - RNA, 74 nt, Human
gugucagugaaaaauugugauaguguucucugcaaaagaagcagacaguuccuagggcaguauuucacagacac

SEQ ID NO: 4198259 - RNA, 67 nt, Human
gugucauaauuucuguuucaguggucuucugaauguccagagccacuguaaggggaauugccuaugc

SEQ ID NO: 4198260 - RNA, 64 nt, Human
gugucauggcacguuagguguuaauuaggaaucgucuaaagcaaaaaugaacugccaucugcac

SEQ ID NO: 4198261 - RNA, 67 nt, Human
guguccaccguucagcaccagaggcagccguaacuccugccuuugggguaagagagaggugguuagc

SEQ ID NO: 4198262 - RNA, 56 nt, Human
guguccagagaacugugggagcccagaggagggagccccaauucugucuggagcau

SEQ ID NO: 4198263 - RNA, 57 nt, Human
guguccagucauagcccagggcagacauaguuuauccugcacagccuuggcugacac

SEQ ID NO: 4198264 - RNA, 62 nt, Human
guguccauauaagaagacggagagagaccagagccguuucucucucuaccaugugaggacac

SEQ ID NO: 4198265 - RNA, 55 nt, Human
gugucccaggcagucacuaccuauagauuagagcugaugugcuggccuggggcuc

SEQ ID NO: 4198266 - RNA, 64 nt, Human
guguccccucaaaauucauauguugaagccuaaaccccaacaugauaguauuuugaggugaggc

SEQ ID NO: 4198267 - RNA, 74 nt, Human
gugucccgggcucugggaugcaaacagaaucugccuauacucagaauacucacuguaaucccggcgccucacac

SEQ ID NO: 4198268 - RNA, 67 nt, Human
gugucccuggcugccagcauuugggggauggugcuaggacucucccauucagcuugcagucauucau

SEQ ID NO: 4198269 - RNA, 55 nt, Human
guguccuaauuuauagcugggucucauagcagaagccagcucugugguuagauac

SEQ ID NO: 4198270 - RNA, 63 nt, Human
guguccuaccaugaauucacuccaugcuagccacauuggccuguauggcuauuccuuggacac

SEQ ID NO: 4198271 - RNA, 83 nt, Human
guguccucaggguggggcagguuggcacuucccucuggcucuccccggagcagggcuugccgcuuguccuccucucuacucac

SEQ ID NO: 4198272 - RNA, 59 nt, Human
guguccuguucagaagcuugggcagggaagagaugacucgggugaguugagcaggacac

SEQ ID NO: 4198273 - RNA, 64 nt, Human
guguccuuauaagaagagaugccagagaauugaaacgcucucucucuucaccauguaaggacac

SEQ ID NO: 4198274 - RNA, 59 nt, Human
guguccuuauauuguggaaggggcaagggagcucucuggggucucuuuuauagggacac

SEQ ID NO: 4198275 - RNA, 57 nt, Human
guguccuuaucgcgaaagugggacaacacccacuuuauaaaauuggugugaggaagc

SEQ ID NO: 4198276 - RNA, 79 nt, Human
guguccuucucuggcauagcaagcagguccacagcagucccgggaagguuuacacccuucuugcugccggaggagccac

SEQ ID NO: 4198277 - RNA, 89 nt, Human
guguccuugggucagaucuuuggggaugcugugguucugaaaacaaagguacaucccacaguucuccagugggaucugccuguggacac

SEQ ID NO: 4198278 - RNA, 70 nt, Human
guguccuuugugagacagaaggguuauucugcaaauaaggaauaauuucucaauuguuacagguggacau

SEQ ID NO: 4198279 - RNA, 83 nt, Human
gugucgccagccucuggcccuagacugcuucaucacuccccaucuuauauuaugaacagcuuugugcucagauuuguggacac

SEQ ID NO: 4198280 - RNA, 62 nt, Human
gugucggggagagagccugcagggaaggguaaagcccgugggggcagggcucucccagaugc

SEQ ID NO: 4198281 - RNA, 129 nt, Human
gugucgggggccugaacacgaagucgguagaggagcaggucuccaggcacggcuccggcaacaccaacaggaagcgggccaccuuggagagcgcucuuccacugcuggaguuccuggucaauacggcau

SEQ ID NO: 4198282 - RNA, 76 nt, Human
gugucuagcacuuggcagguacccauuggcuguauggauaacaaccauucaguuugggauauuuggagucugacau

SEQ ID NO: 4198283 - RNA, 118 nt, Human
gugucuaucugaaaccacauuuucacccuucgccacuaagugcugaauugugcucuuuacaugugaguaauaauauaguguugcuuaauuuagcaauggcuugugauuucagagacau

SEQ ID NO: 4198284 - RNA, 60 nt, Human
gugucuccaggaucucaggccucucucaagcccaaaaggggcccaggaucucugaggcau

SEQ ID NO: 4198285 - RNA, 62 nt, Human
gugucugagaggauuccugucccgacccugcccggugggcgugcuggcuuccucucugccac

SEQ ID NO: 4198286 - RNA, 59 nt, Human
gugucugccuuuggacuaacuggacugagcuagggauguugguguuagaggacagacau

SEQ ID NO: 4198287 - RNA, 57 nt, Human
gugucuggaacgggugguacucagucaauuauccuaucuagcaucugugacggacac

SEQ ID NO: 4198288 - RNA, 66 nt, Human
gugucuggcuucccucuguucugggccggcuccgaaacgcgcucaagagaaaucggaaucagacac

SEQ ID NO: 4198289 - RNA, 64 nt, Human
gugucugugacucuuaccuacccagccuggguuucccagucuuuuauguaaaagucaaauauac

SEQ ID NO: 4198290 - RNA, 75 nt, Human
gugucuguguguauuucgagcaagaaaaugaauuucugaaaucuggcuuguuuuaagaauacaaacauuagauau

SEQ ID NO: 4198291 - RNA, 81 nt, Human
gugucuguguucacauguguccacccuugaacacauacuuauccuuccauacauguguucaucugugcauacgucgggcac

SEQ ID NO: 4198292 - RNA, 81 nt, Human
gugucuugcacacauucuuuaaaugucuguuaacuaaugaaugaauugacaagaaagcagcauuaagggaacugcagauac

SEQ ID NO: 4198293 - RNA, 60 nt, Human
gugucuuuugcaacuacucaacuccacuguugugguauaaaagcagcuguagauagacac

SEQ ID NO: 4198294 - RNA, 87 nt, Human
gugugaaauugcugggcuaagggaaggcuuuugacauuuccuaguugaguuuuagggaaccuucucaagucuuccuucagauuacac

SEQ ID NO: 4198295 - RNA, 84 nt, Human
gugugaagagcucugacaguaaaucaacagaauaucuguagugagaggcauuggguguuccaugacuuacugugcuuugcacac

SEQ ID NO: 4198296 - RNA, 66 nt, Human
gugugacuuugucaaguugcauagauauugaaauaaccauaauuuuaucacagugacaagguacac

SEQ ID NO: 4198297 - RNA, 69 nt, Human
gugugacuuuucaguaacaagccacaguuguauuucaugugcaauugcccgcacauugagaggugacac

SEQ ID NO: 4198298 - RNA, 76 nt, Human
gugugagacacaugcaagaaacagagacgcugagaaacuucaccaggcucagccaccauguuucuuacaucuccau

SEQ ID NO: 4198299 - RNA, 67 nt, Human
gugugagaggagcagaggaucugggggagggaagggcccaacaccccaagccugugcccucugacuc

SEQ ID NO: 4198300 - RNA, 81 nt, Human
gugugagaucugcaugguauuugcuuuucauggugcccacccaagcaaugauuggcacuagauacacagugggucacaugc

SEQ ID NO: 4198301 - RNA, 74 nt, Human
gugugauucuuaaucugcuucugacaucuuugaaggugaaguccauuucagacagcagggagcaggauucacac

SEQ ID NO: 4198302 - RNA, 77 nt, Human
gugugcacuggcuuucuguuauaaagacauugcuaccaaggcauguuauuaauucuuagaauauugucauuguacau

SEQ ID NO: 4198303 - RNA, 59 nt, Human
gugugcagggggccagcgcagccacugggcaucuggggcagcgcuggucgccuggccac

SEQ ID NO: 4198304 - RNA, 59 nt, Human
gugugcauaugaauguguauacacauguaucgagcauguguaugcacgcacaugcacac

SEQ ID NO: 4198305 - RNA, 72 nt, Human
gugugcaugcacacaugugugagguguguaauauauauauaacuuuauaucugaccaaguuuugcaugccac

SEQ ID NO: 4198306 - RNA, 99 nt, Human
gugugcauguguguuugucuaaauguagcuugaaguguagauguuuccccaaguggcuagacacuacaaucucagaacuauaagaacacagauuuauac

SEQ ID NO: 4198307 - RNA, 63 nt, Human
gugugccaacaaaagacagugccucccaaccuuauuucagggcuucacucguaguugguaugc

SEQ ID NO: 4198308 - RNA, 66 nt, Human
gugugccaagagauaguugcugccaaugccaacggcagcuauuuacugagugucucuccuguauau

SEQ ID NO: 4198309 - RNA, 70 nt, Human
gugugcccaaggacaaggucauuaaguucucuauucaaggcauaguagaggccaccacugucagggacau

SEQ ID NO: 4198310 - RNA, 55 nt, Human
gugugcccuggcuccagcaccaauggguagaagauguuagguggccaggggauau

SEQ ID NO: 4198311 - RNA, 67 nt, Human
gugugcccuggggagcccagccaggcgcucacugcuggggucuggccaggggucccugaagggccau

SEQ ID NO: 4198312 - RNA, 70 nt, Human
gugugccugacaugaugguuaaaaggauuaaacaaaacaauaguuuguaauuuauucugucagagcacac

SEQ ID NO: 4198313 - RNA, 119 nt, Human
gugugccugcucugugccaggcacugucaggugccgggaaugcagcaaugaacaaaauguagaucaauuccugcccucuugggccuuacuaccuggcagaagauauaaaaaagggccac

SEQ ID NO: 4198314 - RNA, 62 nt, Human
gugugcgcgugcacgcauacuugcacacguguguguaugcaagugugugugcaugugcgugu

SEQ ID NO: 4198315 - RNA, 87 nt, Human
gugugcuaguuucaguaggacuugugcuuucauugcaauugucaguaugcuuaagcaggggucucugcuaaugaaauucgagcauau

SEQ ID NO: 4198316 - RNA, 92 nt, Human
gugugcugggaguucuacgugucauaucucuuuuaagccucacaucauuuacagaggaggcacugagaggcuguguugccuccccuggccac

SEQ ID NO: 4198317 - RNA, 55 nt, Human
guguggaaagaguggccucucaaucgaugguucugaggcuauugaauuuccauau

SEQ ID NO: 4198318 - RNA, 75 nt, Human
guguggaagccgggacacuuugcacugugcagcaucuugggcagcauugcaguucccucucaugggcaaucacac

SEQ ID NO: 4198319 - RNA, 77 nt, Human
guguggauagugagguauaaggacagaggugauauuaucucucccuacuucugaaauuucaacuuuacuaauagcac

SEQ ID NO: 4198320 - RNA, 59 nt, Human
guguggcaccuccuuuccagcuccucagggaaugugagacaugugaggagcugccacac

SEQ ID NO: 4198321 - RNA, 88 nt, Human
guguggcaguggcgggugcuguggcagcuccuccucuccucuccugacagaguagugagucagucacccuggaccugcugaccuacac

SEQ ID NO: 4198322 - RNA, 66 nt, Human
guguggcucagcgcggccuggucuuucccgggaauugcgaggaaggccacacuugcuggccagcac

SEQ ID NO: 4198323 - RNA, 64 nt, Human
guguggcucagucuggguugacugauugcuuuccuuguaauuaaaaucuuaauuagagugacac

SEQ ID NO: 4198324 - RNA, 67 nt, Human
guguggcuugcucuaugaaguucuuuggcaauaugcagaacuggaguauucaaaaggcaagcuauau

SEQ ID NO: 4198325 - RNA, 58 nt, Human
guguggcuugggugaggcgccugcaugagggcagggcuaacugacugauaggcuucac

SEQ ID NO: 4198326 - RNA, 62 nt, Human
guguggcuuucuggguuuaauuuuuauugcugcaaauaggaauaagaucuuaaagguuauau

SEQ ID NO: 4198327 - RNA, 55 nt, Human
gugugggauccgaggugaauuaggcaucaugggccuggccuuggggagcucacac

SEQ ID NO: 4198328 - RNA, 79 nt, Human
gugugggcugcggauaggccucggaccuguguaggccuuccuagcuggccaguuucuguccgggucucgcuccccacac

SEQ ID NO: 4198329 - RNA, 89 nt, Human
guguggguguguguaucucgugugugggcugaaugcauguggaucugugcccagguauuuaugagagcacauaugaguguccccaucac

SEQ ID NO: 4198330 - RNA, 65 nt, Human
guguggugacagcugggaggaugacauaaggagcuccuuguggcaccucccagaugucucugcuc

SEQ ID NO: 4198331 - RNA, 77 nt, Human
guguggugaggcccagcauucagggcaggaagaaucguacaagaggugucugucuuugugcugggaucucauugcau

SEQ ID NO: 4198332 - RNA, 66 nt, Human
guucccuugaaaguagagacugagacaagugcuucugugcaguuaagcaguuuaugcuuuggggac

SEQ ID NO: 4198333 - RNA, 70 nt, Human
guuccuaauuugguuucugaugacauucuggcagaauugaauuuuguucuuggaaaucagguccuggaac

SEQ ID NO: 4198334 - RNA, 79 nt, Human
guuccuauuuuucuuauuuugccaugggccaguggaaaacuuaccacuaguucuagguauaguaagaaauuccugugac

SEQ ID NO: 4198335 - RNA, 76 nt, Human
guuccucacagcccuuggcccaggaccccccaagucuccaccuccauggcuccugggaaguggcuggcugaggggc

SEQ ID NO: 4198336 - RNA, 97 nt, Human
guauuuucuauuaaaaauacccauagcuuaguauauuuuguugcaauucaaauagagcaaaguuuugaagauaaauuguacugaagauaggaaaugc

SEQ ID NO: 4198337 - RNA, 75 nt, Human
guauuuucuguccuuuagcaacgaugaugauauuugccaccagcgagugugaucugugaggcgauuuuaaaaugc

SEQ ID NO: 4198338 - RNA, 77 nt, Human
guauuuucuugacauaucuguaagaguaggagagcguacuuucucuuucuuuguaugucuauugaccaaggaaaaac

SEQ ID NO: 4198339 - RNA, 81 nt, Human
guauuuuuaguagagacgggguuucaccguggucucgaucuccugaccaagugauacacccgccucggccucccaaagugc

SEQ ID NO: 4198340 - RNA, 55 nt, Human
guauuuuuaguagagucggggucucaccauguugcccaggcugaauuaaaaauau

SEQ ID NO: 4198341 - RNA, 72 nt, Human
gucaaaagaaauagcaugguucagagugaaauuuucuggaacaggagagagcugagcuuugcuguacuugac

SEQ ID NO: 4198342 - RNA, 76 nt, Human
gucaaaagauggguaaugugccuguguauguguucaucagacccugacgcaccugcccggggacauuccuuuagac

SEQ ID NO: 4198343 - RNA, 78 nt, Human
gucaaaagcuauagucuugccagugaauucagaacuaucacagaagaaacgcuggcauuagggcaguggccuuaugac

SEQ ID NO: 4198344 - RNA, 81 nt, Human
gucaaaaggucaugauaguuuuuaaauuuuguuuugcgcaccuacgcuugauaauuuuagucugaaaauuguaauuuugac

SEQ ID NO: 4198345 - RNA, 67 nt, Human
gucaaacagaauuuacacaucucuaaaauguccuggaaguugauggaggaaguaaaauuugauugac

SEQ ID NO: 4198346 - RNA, 89 nt, Human
gucaaauuaaugaauuuauugucuucguggugccuauuacuaggccagauccuggaguagggcuauaagagaauaagacauuuugugac

SEQ ID NO: 4198347 - RNA, 62 nt, Human
gucaacaacugaaaagcuuuuucuguuaaguagauacauggcagagcauuuuacuuguuggc

SEQ ID NO: 4198348 - RNA, 66 nt, Human
gucaacauggaucaaccuauuuucuugguaaguggauaucaaagaaaauaacuugguuuguuugau

SEQ ID NO: 4198349 - RNA, 60 nt, Human
gucaacuauggauaaagcugcugcaaguauuuguauacaggucuuguccauugugugggc

SEQ ID NO: 4198350 - RNA, 111 nt, Human
gucaacucagggggcauguuugguuuaguaccugccagcguguuguugacaaacaccauauacucucuguugcaaagccaaaacaugaccuuuuccacaaauggaguaagc

SEQ ID NO: 4198351 - RNA, 73 nt, Human
gucaagaacugugaagagucugagaucuugcuccacuugcaagcuaauaaguuagacuuuuacaguuucaugc

SEQ ID NO: 4198352 - RNA, 56 nt, Human
gucaagacuucaccgcucugugcuucccuucuggaagcuggaggguaaguuuagac

SEQ ID NO: 4198353 - RNA, 62 nt, Human
gucaagccuaacuuuaaugggaccaggaaguauacuccucccauggagguggugggaauggc

SEQ ID NO: 4198354 - RNA, 55 nt, Human
gucaagguuugaaaacgccauggcauaucaugccguggacuauucagaccuuagc

SEQ ID NO: 4198355 - RNA, 68 nt, Human
gucaaguggaauucaaaauguaggcaugacaauaaaacagcccuggauucugagguccaacaggugac

SEQ ID NO: 4198356 - RNA, 112 nt, Human
gucaaguuauucuuacgucuagaaauaauaagcuuuugauucacuucagaauauuuugagcugacgucaaggcuuuuaauacaauuuuguugaugcgggagcauaauaugac

SEQ ID NO: 4198357 - RNA, 69 nt, Human
gucaauagcauacccaguaucuggacaagaguacuucucuggaagaugaccuggguaaaacuucaugau

SEQ ID NO: 4198358 - RNA, 60 nt, Human
gucaauaucgccaagugucucuugaacuugcuaacaagaagagaccagaggugaguugac

SEQ ID NO: 4198359 - RNA, 66 nt, Human
gucaauaugguuauaagagccuuucagagcaaaacuuaaaaccucagggcuagguagccauuuggc

SEQ ID NO: 4198360 - RNA, 57 nt, Human
gucaaucagcaagcauuuauugaguguguauguacauacaggcaugcuggaguugac

SEQ ID NO: 4198361 - RNA, 61 nt, Human
gucaaugaguauguucucuccgaaguuuguuagcuuagggaauugggaggaugccacugau

SEQ ID NO: 4198362 - RNA, 115 nt, Human
gucaauuaccuuaguguugugcuuuaauauuuuuuucagauucuuuagccucauagcaaaaacuuuggucuauuaguuugaaaguauugacagaaguagcauuaaggaaguuuuc

SEQ ID NO: 4198363 - RNA, 68 nt, Human
gucaauugcccaucuccuguuugcuuuauggggcgcacccagcugaggaggaaugauggguagaagau

SEQ ID NO: 4198364 - RNA, 83 nt, Human
gucacaagggaguugcugcaugcagguuuggugcagaaaaacaaacaaauacaucaccucuguucagugaauuccuccuugac

SEQ ID NO: 4198365 - RNA, 61 nt, Human
gucacaauauagucugcagagaucuuggcuaucuugacauucuacagacuauaacugugau

SEQ ID NO: 4198366 - RNA, 67 nt, Human
gucacacaguucucuugauuaucuggucccuucaagggguuccacauacaaauggggugcuguugau

SEQ ID NO: 4198367 - RNA, 95 nt, Human
gucacaccugucacuucuguuuaguaccucuuccuaguaaggagaacguaugcucccuuucuggaagggucuacuuagcagaaacgaggaguggc

SEQ ID NO: 4198368 - RNA, 72 nt, Human
gucacacuucccuccagucucaauccagcagcuuuccugaagguaaagcuuccugcaugggacugcugugau

SEQ ID NO: 4198369 - RNA, 80 nt, Human
gucacagaagaagaccaaaggaccugggcagcacagggagcagagugccuguccugggggugguccuugcuuuugugcac

SEQ ID NO: 4198370 - RNA, 64 nt, Human
gucacagacaggucaggaauuugauuguuuaacauuccucagaauuuauggccuucgucuugau

SEQ ID NO: 4198371 - RNA, 60 nt, Human
gucacagacgggacaacgugcagcugccgccaccggccaggcugcugucaccgcugucac

SEQ ID NO: 4198372 - RNA, 56 nt, Human
gucacagaucucuugagucaaggagaugggaacuuaggcucaucuugucugcugac

SEQ ID NO: 4198373 - RNA, 61 nt, Human
gucacaggcaguaacuaggaccucuaacagcugaucacagagcacuuaggcaggccugggc

SEQ ID NO: 4198374 - RNA, 57 nt, Human
gucacaggguccccauauggagaagucuuguuuucacggggguuuaaagcccuggac

SEQ ID NO: 4198375 - RNA, 58 nt, Human
gucacaguaucauguuugaaugacugcauaaauaaagucagaaugaacaugcugugau

SEQ ID NO: 4198376 - RNA, 58 nt, Human
gucacauaaagauuucuugaugagccauacaaccuuauccagguaugaauugugugac

SEQ ID NO: 4198377 - RNA, 70 nt, Human
gucacauggccacaucuagcugcaagggaagcugggaagcguaaucuuguauucagaguggacaugagac

SEQ ID NO: 4198378 - RNA, 79 nt, Human
gucacauguacaggcuuuagccaaucacuguggucagagguaggcuauguuuugauugguuaggucugagucacgugau

SEQ ID NO: 4198379 - RNA, 55 nt, Human
gucacauguugcauuaguguggcauguuugucacaauuaaugaauacauuuugau

SEQ ID NO: 4198380 - RNA, 96 nt, Human
gucaccaacuugucugaguccagugggagcaaauacacucauaugcaacaaguuauaugaagcagauuuauuacucacagauuggcagcaagggac

SEQ ID NO: 4198381 - RNA, 72 nt, Human
gucaccaguaggacauuugguuaagagauaagaggaggaaucauuugucucuccugaugaucugguggagau

SEQ ID NO: 4198382 - RNA, 59 nt, Human
gucaccauggauaagaaucacuggaacagcuuguuaaagcagauucugauucuggaggc

SEQ ID NO: 4198383 - RNA, 57 nt, Human
gucaccauugcccacuccauggccagaaucagggccaagaguggcugaggaggugau

SEQ ID NO: 4198384 - RNA, 119 nt, Human
gucaccuacaagagcuucuacaacuacggaugccaagacucuaucuuuagagaucaaguuucaauuggucuggggauggugucuuuguaucuguauauuuugaaagcuuuucuggugau

SEQ ID NO: 4198385 - RNA, 128 nt, Human
gucaccucaggauggaguugagcuggggccugccuuacacuucuggcagcucuaucauguccccugagaucugcccacagcaaagagguaggaaacgcccugagguucauccauccuguaccagguac

SEQ ID NO: 4198386 - RNA, 66 nt, Human
gucacuagucacccuccaacucuccacuccagccucagccaguagaggaggcgugauucauccgac

SEQ ID NO: 4198387 - RNA, 120 nt, Human
gucacucuggauuauuuuccugacaagccugagaaaagcuuucuuauacaaauuuauucauuuuaguuuguuuuaugagauauuuucugcaugcuuuggauacucaauaguucuuuugac

SEQ ID NO: 4198388 - RNA, 61 nt, Human
gucacuggaauuacaggcaugcaccagcaugcccggcuaauuuuguauuuuuaguagagac

SEQ ID NO: 4198389 - RNA, 59 nt, Human
gucacugguuucaaaggaccgcacaacuuguuaaguugugaaguguucugagacagggc

SEQ ID NO: 4198390 - RNA, 91 nt, Human
gucacuguuaucugcaggaugugcuuuucuuaaggaugaacauauuuugguccacaaguuuccaagacaagcacauuccugccaacaugau

SEQ ID NO: 4198391 - RNA, 56 nt, Human
gucacuguuguuccauugcccuagcaaguaacugggcuugggagcaggcaugugac

SEQ ID NO: 4198392 - RNA, 75 nt, Human
gucacuuaauaauuuguuccacacauauuuacuggauaccuacuagguuuauguuuggugcaggaggaaguagac

SEQ ID NO: 4198393 - RNA, 67 nt, Human
gucacuuaggaacacuuacugguacuauacuuacugcaugcuaagugcuggguuggauccugaggac

SEQ ID NO: 4198394 - RNA, 67 nt, Human
gucacuuaucuggccaccaagagcuugcucaggggacacccugcgacucuuuaagguggccaagggc

SEQ ID NO: 4198395 - RNA, 82 nt, Human
gucacuuauuuuagccagagcauuugcauggaccccaggcccccuggaggcccugugcgacucuagagguucaaauaaugau

SEQ ID NO: 4198396 - RNA, 80 nt, Human
gucacuucaaucugcaagcaauccaggaaggcuaccugaaggaggcagcacuugguccaagcuugaaagauugaguagac

SEQ ID NO: 4198397 - RNA, 57 nt, Human
gucacuucucugauaaucucaguuucccaggacauagcugagaaccaagaggaaggc

SEQ ID NO: 4198398 - RNA, 82 nt, Human
gucacuucuguaggcuucaagaggcuacugaaauaucaauggcagcuuugcaguguucucugagaugcuugaagaggaugau

SEQ ID NO: 4198399 - RNA, 59 nt, Human
gucacuuguccccaguagccuguuuccaacaagaaccaacaggaguggggauuggggau

SEQ ID NO: 4198400 - RNA, 64 nt, Human
gucacuugugccuggcacacagaaggcaaguaagagacuugauuucaguuuuaggcagagugac

SEQ ID NO: 4198401 - RNA, 67 nt, Human
gucacuuuauuaauuuuggugagaaaugcuuguggccugaguuggagugccaguuaauggaagugau

SEQ ID NO: 4198402 - RNA, 96 nt, Human
gucacuuuuaccagguaacacuuguuuggucucauguuuaagccaagucuugcuccuuaaaagagcagcccagcauaugauaagugguagaagggc

SEQ ID NO: 4198403 - RNA, 56 nt, Human
gucagaaaaagcaaggcugggcagggaaauucuucagaccgugcugcagaucugac

SEQ ID NO: 4198404 - RNA, 60 nt, Human
gucagaaaccagucaaacaagaacauccggccaggguccugcuugcugggugguuucugc

SEQ ID NO: 4198405 - RNA, 98 nt, Human
gucagacacgaucccugcucucgaggagcuucuggccacaugggggagguggcagggacccagcucucuguggugggaggcugaguagauaggucagc

SEQ ID NO: 4198406 - RNA, 57 nt, Human
guggcagcaaaauccugcauuccuaugagcaacauaugaauguuucacuugcuccau

SEQ ID NO: 4198407 - RNA, 74 nt, Human
guggcaggaaggggcucacucuggccccaccaaggugagguggggaccaagugauagagcccugauccacccac

SEQ ID NO: 4198408 - RNA, 120 nt, Human
gucaggagcccugggugcaauauuuaaggaggccuucacuucagggcccccgcaaaugcagugcuggugccugggugagggucuccuucaauuuuaugcuagccuggugcuaguucugac

SEQ ID NO: 4198409 - RNA, 57 nt, Human
gucaggcaucaguuuccggguguuuuucauaauggauuucacaggagaugaccugac

SEQ ID NO: 4198410 - RNA, 97 nt, Human
gucaggccuucaguucuaaaguagaaugucuguuucaaaaugcuaacuagaacagccugguggaaaaacauucugugggauuccagaaaggucugau

SEQ ID NO: 4198411 - RNA, 67 nt, Human
gucagggaugagaaagcucucuaaggcucauuuuauuuagugccugcaggguuuuguuauucucugc

SEQ ID NO: 4198412 - RNA, 65 nt, Human
gucagggcacugucaccugauauggaggaugaagccccguguuggguuagggcacugccacugac

SEQ ID NO: 4198413 - RNA, 59 nt, Human
gucagggccaucuuuugccucaagugaugaaugauuugucagguccugauggcccugau

SEQ ID NO: 4198414 - RNA, 74 nt, Human
gucagggccgcuggguucgaugaguggagugugggcgccaccuccuggcugcucauggaaccacagggcuggac

SEQ ID NO: 4198415 - RNA, 92 nt, Human
gucaguacaauguaaaauucaguuccucagccacauuacagguacacaauugccacauguggcuagggaauaaaauauugcacaguguagau

SEQ ID NO: 4198416 - RNA, 76 nt, Human
gucaguagcucaguaaugggcauucaaauucacaugaauucaugugaaauugaaugcccauugcugagcuacuuac

SEQ ID NO: 4198417 - RNA, 72 nt, Human
gucaguagucugggcggcgguggucuccccgcagguggccgcuggcuccucaggacugcgggaucugcugac

SEQ ID NO: 4198418 - RNA, 70 nt, Human
gucagucauugaaugcuggccucuuggaggaaaggugacaacaggugaggccagcaccauaggggcugac

SEQ ID NO: 4198419 - RNA, 55 nt, Human
gucagucuccugccuuuuggacacuauaugcaugcccagguggcagggaauuuac

SEQ ID NO: 4198420 - RNA, 68 nt, Human
gucagucuugcuagagguuugucaauuuuauugaucuuuucaaaaaaucagaucuuugguuaauugau

SEQ ID NO: 4198421 - RNA, 56 nt, Human
gucaguguagguucaucagugguaacaaauguaccacuuugaugguggaugcugac

SEQ ID NO: 4198422 - RNA, 79 nt, Human
gucaguguugcagguaucaacuguacauuauucaaagcacccuaggauucugugauaguugauccuuagaaauaccagc

SEQ ID NO: 4198423 - RNA, 79 nt, Human
gucaguuccacuuaauugcauuaucuauguauugagaaacaucaaucucuagacauggggaaugucaucgugaacugac

SEQ ID NO: 4198424 - RNA, 75 nt, Human
gucaguuccuuguccuuguccuuguuuguccuuccaugaagggacagucacuuccaggagaggacagaauuggac

SEQ ID NO: 4198425 - RNA, 77 nt, Human
gucaguuuaggagagacgcguucuuuaucugagccacacaaccgggcagcuggagcgaggucuugguccuggagugc

SEQ ID NO: 4198426 - RNA, 68 nt, Human
gucaguuuccaggcacuggggcucuuuucuuuggagaaugauacauccaggcugggacuucaacuggc

SEQ ID NO: 4198427 - RNA, 111 nt, Human
gucauaaagaucugcuagcuucagaaauaggcucucaaaugugaccuucauuuaaauguguaaggcaauuucagggcucucuaacauuucugaguuuaagguacuauugac

SEQ ID NO: 4198428 - RNA, 120 nt, Human
gucauagaaaaguccaaaaguagaacuaggacuucagguauagcuugauccaggaguucaagucaugccucccuguccuucaguucaugguuauuuuauucuuggcauugauguuguggc

SEQ ID NO: 4198429 - RNA, 71 nt, Human
gucauagcagcuaccuggcuaagagucucaguucacuugugggacauuuguauuuggugaguggugaugac

SEQ ID NO: 4198430 - RNA, 77 nt, Human
gucauagcaguauuccuuccuaccucccccugaacauuuauucaaauauucuucagagaguagaagcaagcugugau

SEQ ID NO: 4198431 - RNA, 118 nt, Human
gucauagcuuccuuaguuuucugauaaguugcagagguugcaaugugggagauuuucuugcuacuuaagaaauacuuuguaaaucucacaaugauuaagaagucugagaagcucugac

SEQ ID NO: 4198432 - RNA, 60 nt, Human
gucaucaucaggcagaugcugcuccagugcgaggacgaugcaauucgcuaugaugguggc

SEQ ID NO: 4198433 - RNA, 69 nt, Human
gucaucaugucauguuuuccuacaagguaacaauaaugaugcugccucuagaagaugugauaaugugau

SEQ ID NO: 4198434 - RNA, 64 nt, Human
gucauccugcaccaaaguuggcuuggagaaacugccccuccuccagcccuugcugaaggguggc

SEQ ID NO: 4198435 - RNA, 58 nt, Human
gucauccuucuggaacuagucuaagucauccuucuggaacuagucuaaaagggcugac

SEQ ID NO: 4198436 - RNA, 63 nt, Human
gucaucuaguuuguuuccauuuauuguuuuuaauauuaagacagugauguaagcaggagugac

SEQ ID NO: 4198437 - RNA, 63 nt, Human
gucaucugagacuaucuagauuuuaaggaauaccaucaguagaucacauaguuaucagaugac

SEQ ID NO: 4198438 - RNA, 64 nt, Human
gucaugaaauucuagagcuugaagggacuuuaacaaaucuagcccagcccuuugauuuuaugac

SEQ ID NO: 4198439 - RNA, 64 nt, Human
gucaugaagccaugugugcuuuuggcaguaccaccuuugccuccacuuuugcuggcuucuggau

SEQ ID NO: 4198440 - RNA, 72 nt, Human
gucaugagugaguuuggucagaauguuuuuggcugcaaauaacagaaacucaaauuaaacuagcuuaaugau

SEQ ID NO: 4198441 - RNA, 87 nt, Human
gucaugauauaaaccuuggccuguuuuuccuacuagaugauaaaaugcgaacaguaggagccaagcagaacuaaggaaggaugugac

SEQ ID NO: 4198442 - RNA, 77 nt, Human
gucaugcgacugguggccaaguuugaggcagguccuuggcuucucacagacaccuuggccacagucacugcgucugc

SEQ ID NO: 4198443 - RNA, 68 nt, Human
gucaugcugccugggguccuagccuggcccacacucugugucuugcugugugacccuagccaguagac

SEQ ID NO: 4198444 - RNA, 56 nt, Human
gucauggaaggaguggccaaguggaguuucugucugcacagcuugccuuuuaugac

SEQ ID NO: 4198445 - RNA, 96 nt, Human
gucauggaagggagucuggacuuuaucccaagguuaggagggagccguugauggguuuuaaaccggggagugaugugguuuagcuuccuugguggc

SEQ ID NO: 4198446 - RNA, 77 nt, Human
gucauggacagccuguagaccaugccuaccccccggggccuucaucccccauguuggcagggcugcuugucuaggac

SEQ ID NO: 4198447 - RNA, 55 nt, Human
gucauggaggauugugagugguugagaaccacugccauaccccaucucucaugau

SEQ ID NO: 4198448 - RNA, 62 nt, Human
gucauggccaacugaaaugaaagauacauuucucaucuuugcauugaguaguggcaugugac

SEQ ID NO: 4198449 - RNA, 78 nt, Human
gucauggccaguaugaagaagacaaaugacacuccucacgugucuguggagagguccugucuaucacccucgccagau

SEQ ID NO: 4198450 - RNA, 83 nt, Human
gucauggggaauguuagaggaguuuaguuuuguaauuguauaaaaaacagaacauauugcuucucucaagagcaacccaugau

SEQ ID NO: 4198451 - RNA, 77 nt, Human
gucauguaacuaggaaguggcaaaacuggaauuugagaccaaaucucuccgaaagagccuggcuucuagcuacugac

SEQ ID NO: 4198452 - RNA, 69 nt, Human
gucaugugcuggauagaggaggaggugggagggcacacaacuuccaagagccuuucuucuagaugugac

SEQ ID NO: 4198453 - RNA, 77 nt, Human
gucauguuaugcuucucuuugaaaauauccagcagcaauuuauugcuuaaaggauaguuuaaacuccauaacauggc

SEQ ID NO: 4198454 - RNA, 63 nt, Human
gucauuaaauaucaaccuagacuacuaauaauuagaagugguuuuaaaagauguuugagagac

SEQ ID NO: 4198455 - RNA, 64 nt, Human
gucauuaaucaccguggagccaauggcagcucuccaggcccuauucuucaugaugauuaauggc

SEQ ID NO: 4198456 - RNA, 84 nt, Human
gucauuauggacaucaaauaacucuugucacuaacucagauccuacugaggcacuuagagcuauuugucuguccauuaaauggc

SEQ ID NO: 4198457 - RNA, 113 nt, Human
gucauugguacucaccaucauucaauuuucagucacuucuauucuauuaagugccagggucuuguccucagcugaaucuuagaaugcugaugauugugguagauucaguagac

SEQ ID NO: 4198458 - RNA, 66 nt, Human
gucauuuauuugccugggaauucaagaagcagagaaauuagaagaaacuucucaggcacguguggc

SEQ ID NO: 4198459 - RNA, 64 nt, Human
gucauuugaagaagaaacguacuaauaaaaauauauuucuuaaguacuuuagucugcaaguggc

SEQ ID NO: 4198460 - RNA, 73 nt, Human
gucauuugcugccucaguaggugccggcuggaggagcucccaggcuggcacugcugaaguggcauucccugac

SEQ ID NO: 4198461 - RNA, 64 nt, Human
guucucagcagcugggaggcccagccagagcugguagggcagccacccaggcugcuuggagaau

SEQ ID NO: 4198462 - RNA, 64 nt, Human
guucucaguugugcgcaaaaggagagauguaaguauugaugccaguuuaaguagaacugagaau

SEQ ID NO: 4198463 - RNA, 70 nt, Human
guucuccaacuuguuucuuccauucaacagcaugugaaagcaagcuuagaagcaaaaagcaaaggagaac

SEQ ID NO: 4198464 - RNA, 67 nt, Human
guucuccaccacauggcuucuccguguggcuagguugggcucguggagaggccauguggaggacaac

SEQ ID NO: 4198465 - RNA, 70 nt, Human
guucuccaggcgccuccuucuccacucuuucuccagugcuggagaccuaggggugugcauccuggaggau

SEQ ID NO: 4198466 - RNA, 69 nt, Human
guucucccacaacugaucugcuuagggacagugucccuggugcccugggucagccuuuguaaacagaac

SEQ ID NO: 4198467 - RNA, 99 nt, Human
guucucccaucuaauuuucagcuaccuaaaaagcuguuagcccaaaaggugcuggugaggcuguggguaaacgcugaggguacaaugcgagggacggac

SEQ ID NO: 4198468 - RNA, 82 nt, Human
guucucuauuguaucgcagcaucagggacagugccuggcacuuaguagguaggcccugagugcuguuguuugaauggagagc

SEQ ID NO: 4198469 - RNA, 55 nt, Human
guucucucagccuuuguuauuauuaaugcuuaauuuuaaaggaagaagggaggau

SEQ ID NO: 4198470 - RNA, 61 nt, Human
guucucugccugagaacaauuuucugauugcagaacagaaagcuggagucaagcagaguac

SEQ ID NO: 4198471 - RNA, 57 nt, Human
guucugaaugauagucuugaacucuugagcucagaaguuccucuugucaucagaugc

SEQ ID NO: 4198472 - RNA, 89 nt, Human
guucugcauggaaaacuaauggagucaugauggcugcugaugcugaugaaguaguaccagccagccugauuucauaacuuccauagaau

SEQ ID NO: 4198473 - RNA, 100 nt, Human
guucugccguucugccgucagccuugaaggugccgaugugcccugugggccuggccuggguacccuuggcggccuugcugggagucgaccgggugcgagc

SEQ ID NO: 4198474 - RNA, 66 nt, Human
guucugcucuuuuauugaagaagauucugucauucauugacuggagugaguaucgaugaacagaac

SEQ ID NO: 4198475 - RNA, 55 nt, Human
guucugcuuccuugcuugcgcaugcaguaaacagccccaaguuauccagcagaau

SEQ ID NO: 4198476 - RNA, 80 nt, Human
guucuggccccacgcaucugaaguuugucuuaagauauaagccguuuccuaaagaugcuuccacugcaguggcacaggau

SEQ ID NO: 4198477 - RNA, 76 nt, Human
guucuggcuagaaaguuaaacagugauaagaaauuaugaagaaauuucacaucaaaaacaauuuucagagcagggc

SEQ ID NO: 4198478 - RNA, 65 nt, Human
guucugggaagguggaccuguugcuuuacugucaucuccucugccaucaucuuucuucccaggac

SEQ ID NO: 4198479 - RNA, 105 nt, Human
guucugggauucacuugccuuugccguauaguaaaauuuucauuuaugguuuaugcuguuaaauguuccuuuacuggaaugcaagguggugggacccaagagaac

SEQ ID NO: 4198480 - RNA, 65 nt, Human
guucuguaccuucuguuucaagcaaucaugaacauugaugguugagaagguaagguaccaaggac

SEQ ID NO: 4198481 - RNA, 76 nt, Human
guucugugucugucucuuuugguauucucagacuuauguagucauccauauagaaagaugauuaggaaaauaggac

SEQ ID NO: 4198482 - RNA, 68 nt, Human
guucuguucuucaucauuuuagauaggcuauguuuauuucauuuccuguuuauugugaagaacccagc

SEQ ID NO: 4198483 - RNA, 71 nt, Human
gucuauaacuugcuuucccaaggcagaacauagugauuuaacacuaagaguuuaggggagcaggagaggac

SEQ ID NO: 4198484 - RNA, 63 nt, Human
gucuauuugggaucaugauaugggagccaacuuggaggggcucugacagaccacagaugugac

SEQ ID NO: 4198485 - RNA, 58 nt, Human
gucucaaacuccuaggcuaaagugauccucccacuuuggccucccaaaguguugggau

SEQ ID NO: 4198486 - RNA, 60 nt, Human
gucucaaauuuguuagauaaaauuccugacccuuaagaauuuugucuuuaaaauagaggc

SEQ ID NO: 4198487 - RNA, 78 nt, Human
gucucaacacucuuauuuugcuuugcaaaacucuguaagauuauaagggauauuugauagggaaguaagaaugaagac

SEQ ID NO: 4198488 - RNA, 129 nt, Human
gucucacacuugucuuuucaacgaguuguauauuuaugugugaaaauguaugcuauuuguugccaccuaucaaaggaauagacuuuguauaauuucccacauuggacaauuuaaaaguguuugugaagc

SEQ ID NO: 4198489 - RNA, 61 nt, Human
gucucacaguuggcucauuaaugaacauugugugcaaucaauaaguuaccgacugagagac

SEQ ID NO: 4198490 - RNA, 65 nt, Human
gucucacuuggggucucucaugagguuguagucagauggcagucauaugaagacucaaguagggc

SEQ ID NO: 4198491 - RNA, 58 nt, Human
gucucagaaagauucccuuugaaacucacauaaaacaaaauugguuccuuucugaggc

SEQ ID NO: 4198492 - RNA, 91 nt, Human
gucucagagaagaguggaacagcuuuuuuggucagcauuuugaaauaaaaauuguggaccagguagagcuuuuuggcauuccaucugugac

SEQ ID NO: 4198493 - RNA, 79 nt, Human
gucucagcauauugaaugcccagaaggaagaaguuaggcccaacauuaaccccaagccucuuccaagggcugcugagac

SEQ ID NO: 4198494 - RNA, 86 nt, Human
gucucagcuucucacaggaaguaggacuuuucuuuucucagucauccccaaagaaacagaacuguuguucuggaggagucugagau

SEQ ID NO: 4198495 - RNA, 62 nt, Human
gucucagguucgagccuccuuagggcacccccuuuccguccaccuuagccuggaacugagac

SEQ ID NO: 4198496 - RNA, 74 nt, Human
gucucaugacuaagugcauuuuaauugauauugucuggcugcuuggauccaauuagaacuguauuggucuggac

SEQ ID NO: 4198497 - RNA, 76 nt, Human
gucucauuugccucaucuauaaacggaaacaaugcugguacugaccucauaguauuuuguagggcuuaaaugagau

SEQ ID NO: 4198498 - RNA, 90 nt, Human
gucuccauguggcuggcuccagaguccucccugauaagagaaacaaaccguucugcagacacuggggucuggaggcuccacgugguagac

SEQ ID NO: 4198499 - RNA, 72 nt, Human
gucucccuggcccaauaguggggauauaccugaguugagcuagaggauuuuaucccuguugggaugggggac

SEQ ID NO: 4198500 - RNA, 57 nt, Human
gucuccucaaguuccguggcagacuaguaagacugaguuugacaccuugggagagac

SEQ ID NO: 4198501 - RNA, 59 nt, Human
gucuccuccaguccuccaaggacaaauugaggaguuauuugcucuggggguggagagac

SEQ ID NO: 4198502 - RNA, 72 nt, Human
gucuccugaggcucgcgcgccccuggugggcgugagaggaggcguccccgcggcgguccggccucaggaagc

SEQ ID NO: 4198503 - RNA, 69 nt, Human
gucucgcccgcccugccucucgggcucugcccagcuuccugaguccugacagagcacagugggggagau

SEQ ID NO: 4198504 - RNA, 101 nt, Human
gucucuagaagccaagaguggucacugggaucagcuggaaaacagcucaguccuggagcugcaaggcugaauucagcugagaacucaaugacccuggaggc

SEQ ID NO: 4198505 - RNA, 66 nt, Human
gucucucaggaaugcaucaggcauaaaaaggaaccaaaaguauugccugcuguguuauuguagaac

SEQ ID NO: 4198506 - RNA, 65 nt, Human
gucucuccagccaggggcuuccugaaagagcugccuucugagcaggccccccaggcuaggaagau

SEQ ID NO: 4198507 - RNA, 96 nt, Human
gucucucuacccagcgaccuccugccugagagucuguuggucaauuuagcuguaaccagggucaaaugggcaggaagagucaugugggggagagau

SEQ ID NO: 4198508 - RNA, 63 nt, Human
gucucucugcagcaucuauguucuccagcagugaggacuauuuauaaugcugcagaaaugggc

SEQ ID NO: 4198509 - RNA, 60 nt, Human
gucucugaagucaguuuuucuagucauuucuugagaggcagugagugugacuucacagac

SEQ ID NO: 4198510 - RNA, 58 nt, Human
gucucugccauuccauuaggacucagugucacccaggagccuagagggaaggcaggac

SEQ ID NO: 4198511 - RNA, 57 nt, Human
gucucuggaaauuucaguuuuagagggugauuuucuucuuccugguuuuucaagaac

SEQ ID NO: 4198512 - RNA, 61 nt, Human
gucucuggcagaagccccguggaaccucagccggacaggaggugacgcuucuccagaugac

SEQ ID NO: 4198513 - RNA, 59 nt, Human
gucucugggaaauagaggacccuagagccauauuggaucaggccugauaucccagacac

SEQ ID NO: 4198514 - RNA, 58 nt, Human
gucucugggugugugaugccaaaccuugccaaggggggcacuguguacacacagagac

SEQ ID NO: 4198515 - RNA, 63 nt, Human
gucucugugugugauugugggucugugugucugugugugugcggaaggggucauaauggagac

SEQ ID NO: 4198516 - RNA, 71 nt, Human
gucucuucauauuaugauuugaaaugccuuucacauuaaggcauguguuauuuuauguaugaaaaugaggc

SEQ ID NO: 4198517 - RNA, 122 nt, Human
gucucuucaucuugcucagcuucaguuuccucauccauaaaauuguaucaucaugucuuacaaauaugauuucaguaaugaggaugaaggagaucaggcaccuauggcgucauggagaagac

SEQ ID NO: 4198518 - RNA, 83 nt, Human
gucucuuggaauaaacugcaagauccagguaggguaaaucuaugguuacucaccacacccuugcacuugaaauuuaagaugau

SEQ ID NO: 4198519 - RNA, 88 nt, Human
gucucuuugcuguauuggugaugacuugaggccagaguuugcaaaacagaaaaugcucauauguauuuccaaugccaaggaaggagau

SEQ ID NO: 4198520 - RNA, 73 nt, Human
gucucuuuuggguccagauggugagaguuaaggcuauuauguguauuaaaacaccaucuguauuuuugagaac

SEQ ID NO: 4198521 - RNA, 59 nt, Human
gucugaaaaugcccuacgauugccuuuacaaauaacugguacuucggcaggguuuagau

SEQ ID NO: 4198522 - RNA, 78 nt, Human
gucugaaagccaggaggagggcgcucgccagaaccgaauuugccagcaccuugaucuuggaguucccugcuuucagac

SEQ ID NO: 4198523 - RNA, 83 nt, Human
gucugaagaggccacaaaggcuuuuguuccuauuuagucucuucgaaacuaggugccacaaaggcuuuuguuccuauuuaguc

SEQ ID NO: 4198524 - RNA, 68 nt, Human
gucugaauacguacuugugaaggcguguaaaccggcccuuuaugcuuuuacagccccuuguuucagac

SEQ ID NO: 4198525 - RNA, 62 nt, Human
gucugacacagugauuaguaaauuaauucaacaaauuauugagcaucuacuguguuccagac

SEQ ID NO: 4198526 - RNA, 90 nt, Human
gucugacagcaucuauuccuggccauccugugaccugagaggccccagugccuccucuagacaguagcaugcaccaggaggguaugugac

SEQ ID NO: 4198527 - RNA, 64 nt, Human
gucugacaugagggcuguggagaccuugauucauuuguccaaucucggcagcccugugacagac

SEQ ID NO: 4198528 - RNA, 86 nt, Human
gucugacuugguggguggguuguugcaguugaagucuccaggaaaugcucauggacaggugcacacagcagccaaggggucagggc

SEQ ID NO: 4198529 - RNA, 60 nt, Human
gucugagaggcagaccuuccuaagagacgauaauuuuacagaagugaaggccuuuaagau

SEQ ID NO: 4198530 - RNA, 75 nt, Human
gucugaggcagcuguuccugguuggugggaagcuuucuuccauacagugacucaggaauccaagcuccuuuugac

SEQ ID NO: 4198531 - RNA, 57 nt, Human
gucugagggagaaggaucugggcugggacucccagguccuuucuguacccuccggac

SEQ ID NO: 4198532 - RNA, 121 nt, Human
gucugauagucaaggggcugguuacuauuagguuggugcaaaaguaaaugugguuuuuagaaauaauggcaaaaccccuaauuacuuuugcaccaaccuaauaauucacccacagucagac

SEQ ID NO: 4198533 - RNA, 58 nt, Human
gucugauuuggcugcuucaacagcucaggccagagcuagugacagcaugaauuaggac

SEQ ID NO: 4198534 - RNA, 91 nt, Human
gucugcacuugggggcaggcgcccaaaauucauguccauggcuguuuuuaugccaugcugagacuggagcagcuggcuuccccgugcaggc

SEQ ID NO: 4198535 - RNA, 68 nt, Human
gucugcauucuggauagcuagucaaugcucgaacauuaugguugccuaguaaauccugaauagcaggc

SEQ ID NO: 4198536 - RNA, 63 nt, Human
gucugccauguggagaaagccauacugcaguaugagugauaaagcugccacacagguacagac

SEQ ID NO: 4198537 - RNA, 91 nt, Human
gucugcuacauuuucuugucucaucuuuccucaaaagauccaaguuugggaaaagacugguugugaucagguggaagguggaguagcugac

SEQ ID NO: 4198538 - RNA, 82 nt, Human
gucugcucccugaauuuggugccugggaaaucucuggagacuuuagggagaacaguugcagcagacaaggggccaggaggac

SEQ ID NO: 4198539 - RNA, 74 nt, Human
gucugcuccuccucccagcugggacccagccagcucaguggcaucgcagcagcugggaagacuggaagacagac

SEQ ID NO: 4198540 - RNA, 59 nt, Human
gucugcuguguucagagcugugaccuuugugccuacauagcgccugcaacaaggcagau

SEQ ID NO: 4198541 - RNA, 57 nt, Human
gucugcuuuucugaauugccuguucauagauagguauaggcauaagguuagguagau

SEQ ID NO: 4198542 - RNA, 59 nt, Human
gucugcuuuucugcccuuucaugauucaagucaugaaaccuaaugcgaaaaggcaagau

SEQ ID NO: 4198543 - RNA, 78 nt, Human
gucugcuuuugagucucugccaaaacacaagugacaguggcuaacuuccuugcguugguaagcucagaauaaauagac

SEQ ID NO: 4198544 - RNA, 69 nt, Human
gucugcuuuuuagggauuaguguuugaggagguuugcagcugcucagcacauuccuaagggaugcagac

SEQ ID NO: 4198545 - RNA, 61 nt, Human
gucuggaaauucaauuuaaugcuaugauuauagucagaaugcuuuauuugaaauugcagac

SEQ ID NO: 4198546 - RNA, 63 nt, Human
gucuggaagagcaggaauaaacuugucugggcaaguaauaacuucuuccucuuauccauggac

SEQ ID NO: 4198547 - RNA, 65 nt, Human
gucuggaagcaggccaguaugagacaggaguccccagggacucuguagggacgguucucccagac

SEQ ID NO: 4198548 - RNA, 65 nt, Human
gucuggaagugucuuguuaagugggaaaguaagucaaccaaauagaaacaaggggcuugccagac

SEQ ID NO: 4198549 - RNA, 69 nt, Human
gucuggaauuauuuuccugcugauauuuggugaaguguauccaauauaucacauggaaugauuuuagac

SEQ ID NO: 4198550 - RNA, 74 nt, Human
gucuggacuuaggggcagggacuacaagagagaggacuacccucuccuucuguagucccugucccuaagguggc

SEQ ID NO: 4198551 - RNA, 74 nt, Human
guuguuugaacuuuuccagacaaggaaagaugauuuuuuccauauuuguguggcaaaagggauauucugacagc

SEQ ID NO: 4198552 - RNA, 70 nt, Human
guuguuuguggagguagaaaugaagcucuggugaucaaccagcagggcucaucaagccucuccgccuggc

SEQ ID NO: 4198553 - RNA, 84 nt, Human
guuuaaaaaaaauucuaagcuacuaauuaaagggaaaaaaauuauacucuuaguaguucuagaggcugggaauuauuuucaaac

SEQ ID NO: 4198554 - RNA, 99 nt, Human
guuuaaagauucaguuugcuaucaaagauaauguuuccuuauucugcaguuuaauuagcaaggaggaagcauuuuaucucaaauacugauuuucuaaau

SEQ ID NO: 4198555 - RNA, 79 nt, Human
guuuaaauaugcuuuuuuccaggaagccacuggaaucucuaaaguguuccuggcuaacugggaaaaaauugcagggaac

SEQ ID NO: 4198556 - RNA, 70 nt, Human
guuuaacagauuuuucccucuuuagaaaucaaaaauguaauuuaaaugaguggggagaaauugguuaaac

SEQ ID NO: 4198557 - RNA, 64 nt, Human
guuuaaccaagagcauugugcacagagagaacucauaacuguguguauaagcggauugggaagc

SEQ ID NO: 4198558 - RNA, 75 nt, Human
guuuaaccuuggucaucuuccguuuccucauuauagcaauggggaaaaugcagaagauuacagcaggaguuaaau

SEQ ID NO: 4198559 - RNA, 110 nt, Human
guguuuuacuuacauauuacuuuaguuaacguuuccacaucaccaugaggugaggacuguuaauauucucacuuuacagaugggaaaacuguggcauagagaguuuacac

SEQ ID NO: 4198560 - RNA, 116 nt, Human
guguuuuauuuugcaguguuaguuuugaccucauuaugcucauuaugcuguuguaaggcuaaguaugucaugggucaaaaugaaggcaaaauagaccuuucucagcauuaaagcac

SEQ ID NO: 4198561 - RNA, 76 nt, Human
guguuuucuuucaaagcaaaaugaggcuauaucuugguagcaggaucagcuuggucuuuuuugaaaccuagagcau

SEQ ID NO: 4198562 - RNA, 57 nt, Human
guguuuugugaggccuucuuuccuggcaggguugauggugaauauccuccagaaugc

SEQ ID NO: 4198563 - RNA, 88 nt, Human
guguuuuguuuguuuuaguuuguuuuccuuuuucuaugauuaugugaauaguuuggaagagaaaaauauuuagaaaggaagaaaagau

SEQ ID NO: 4198564 - RNA, 73 nt, Human
guguuuuuacaugccuuacuauccugcuuuuucuuccaagaugagguucaggaaaugggcaaaguagagacac

SEQ ID NO: 4198565 - RNA, 60 nt, Human
guguuuuucucucagccuguagaaacuugcucauugaguuuuagaguugggagaaguuac

SEQ ID NO: 4198566 - RNA, 64 nt, Human
guuaaagcuuaggauagggaauauauauguauguguauaugaaaugaugucuucgaguuuuaac

SEQ ID NO: 4198567 - RNA, 109 nt, Human
guuaaaggacuguuauuguacuugaucuuauagaauguuuuuauauguguuuauaaggacuauauauaauuuucaagcuuuucuaagaugaggaaguaaagucacuaac

SEQ ID NO: 4198568 - RNA, 80 nt, Human
guuaaaugaagcccauuuguacagcacauugcaauucacaaagcacuuucccauaugugcuugcagaugagccucauaac

SEQ ID NO: 4198569 - RNA, 69 nt, Human
guuaaauuuuaguugcugagccagauccuuuagacaagaaauacuggcuuccaguaaucaggauuuaau

SEQ ID NO: 4198570 - RNA, 60 nt, Human
guuaacaagguguagagguuuucucucugaagguguuuaaauuccucuaacuuugcugac

SEQ ID NO: 4198571 - RNA, 57 nt, Human
guuaacaaugaggaucuguucugaggagugcauccuuaggcgauuucaucauugugc

SEQ ID NO: 4198572 - RNA, 66 nt, Human
guuaacgaaugccugccugucacauguggggccuuuauuuuguguucagcaggcaccuucuuugau

SEQ ID NO: 4198573 - RNA, 97 nt, Human
guuaacuauauugcaauaucuuaaaugcaugauagacauaaagccaagugucacuuaaugucgggcaugcauucugagaaaugcaucacuaggcaac

SEQ ID NO: 4198574 - RNA, 69 nt, Human
guuaagauagaauuauggaaagcaucuuuuacaugugauaaaagaugguuucuguagguuuauugaaau

SEQ ID NO: 4198575 - RNA, 69 nt, Human
guuaagcacaguggcuuuugugucugcagauuugagcugaaauuccaguucugcagcauagggcuuaac

SEQ ID NO: 4198576 - RNA, 74 nt, Human
guuaagccaucuuguuuauauguuaagaguacagggaagcuauuauaauguguuuaaagcaagaauggcuggau

SEQ ID NO: 4198577 - RNA, 55 nt, Human
guuaagccuucagaguuggcuggucacauagacaacuauggcugagggccuugac

SEQ ID NO: 4198578 - RNA, 122 nt, Human
guuaaggcaggaaccggccauuuucacuucuuuugugauucuucacuugcuucaggccaucugaauguauacgugcaggucacaggggauaugauggcuuagcuugggcucagaggccugac

SEQ ID NO: 4198579 - RNA, 61 nt, Human
guuaagggcucugugcuugucccauguguuaacauccuaugggccaagcaagacccaugac

SEQ ID NO: 4198580 - RNA, 71 nt, Human
guuaagguaaucucauuagggaccgugaaagaauaugagaauucugucugucuuuagugagauugccuugc

SEQ ID NO: 4198581 - RNA, 67 nt, Human
guuaaguagaaggcauuuugggauagauccuaauagcaucuccccuauacaggcuucuuuacaugac

SEQ ID NO: 4198582 - RNA, 107 nt, Human
guuaagugucaggagguaugggugccuucuuuugaagggcguugugugaccugacagguguaagccaagcucuuuaaaggccaaaaggaugccauccccuguuugac

SEQ ID NO: 4198583 - RNA, 116 nt, Human
guuaaguuugaauuucagauaagcaaugaauaauguuuuuguauaagcaugacucaaauauuagauaggacacacuuaaaacguuaugcauuguuuaucuaaaauccaaauuuaau

SEQ ID NO: 4198584 - RNA, 71 nt, Human
guuaauaaauuaucuuggguaacuuugugcagauguuugucuuucuauugccagauuacccaggauuuggc

SEQ ID NO: 4198585 - RNA, 70 nt, Human
guuaauaucaggaagaacacgugaaauggagaauuucagggcuaacauuucuuguuuuguuucugaaaac

SEQ ID NO: 4198586 - RNA, 66 nt, Human
guuaauauugagcacaaacguuacuagagagugacuaucucucucaguguggugcuuaggauaaac

SEQ ID NO: 4198587 - RNA, 75 nt, Human
guuaaugacuaguccacauuuguaaaauaaauugucuuuaagaggacauuguuacaguuguagaaagugguugac

SEQ ID NO: 4198588 - RNA, 71 nt, Human
guuaauggaagacucauaugccaggguaaagugucuuuauuuuauucuaaguaugaugggaggccauugac

SEQ ID NO: 4198589 - RNA, 92 nt, Human
guuaauuagugcacuuggguuugagagguggguaacaagcugccgcucugcauuuggugguuccuuuuccgaacagguggcaacugacugac

SEQ ID NO: 4198590 - RNA, 58 nt, Human
guuacaaaggacugggggccacaggucugagugugagcccaguagcauccuuuguagc

SEQ ID NO: 4198591 - RNA, 60 nt, Human
guuacaacugaagcuaaugugcugaugggcucaguucccaccaguagaucaguuuguaau

SEQ ID NO: 4198592 - RNA, 68 nt, Human
guuacacauaucuucuguggcuguucucgcauucuggugacagaacucagugacagagacuguguggc

SEQ ID NO: 4198593 - RNA, 94 nt, Human
guuacacugguguguuggguguuuccugaugaauaucucugaagacaauggagaaaugacacacaugagacauuuccagcagaccugaguuaac

SEQ ID NO: 4198594 - RNA, 59 nt, Human
guuacagcuugaugagagcgcgaggaauccuuuuuccuguaccuaaacucagcuguaac

SEQ ID NO: 4198595 - RNA, 63 nt, Human
guuacaguaaaugugguagaaacuguuaaucgcuuaaugccaguuuaaaucauguuuuguaac

SEQ ID NO: 4198596 - RNA, 76 nt, Human
guuaccagaaggaauaugaaugcauggaaaaaaauuuggugauaaauuuccaugaucguuauagaacucugguaau

SEQ ID NO: 4198597 - RNA, 74 nt, Human
guuacccuggguguccacguuggggugauagcagggcgugaggaacuucacugugggcgcauuguaaggguagc

SEQ ID NO: 4198598 - RNA, 103 nt, Human
guuaccuaggcugguuucaaacucuggccucaauugauccucccaccuuggccucccaaagugcugggauuacagucaugagcugccacaaccagccuguaau

SEQ ID NO: 4198599 - RNA, 61 nt, Human
guuaccugaaugucuuauugcucguuguaucuagcauacaaacaauagauauucaguaagc

SEQ ID NO: 4198600 - RNA, 77 nt, Human
guuaccugaugcuucaagcuuccuuauaaucuccuugccaaggggguauuuuaugaauaauuugauguaauaggaac

SEQ ID NO: 4198601 - RNA, 95 nt, Human
guuacgucuagucucugagguggacauguaaaggcucaaggucuccgauuuccugcgacggccuucucuuuugauguccaaaucaagauaugaac

SEQ ID NO: 4198602 - RNA, 64 nt, Human
guuacucucaucccaaguaacugccaucauauuuguuaaaauagcaauguugggguuagaggac

SEQ ID NO: 4198603 - RNA, 62 nt, Human
guuacugaacuucucugagccucaguguucuccucugcauugaccugcucugaaauucaaac

SEQ ID NO: 4198604 - RNA, 72 nt, Human
guuuccucuugggagucccaggacauagggcagggacugcccuguggaccugcucuuagagaccuugggaac

SEQ ID NO: 4198605 - RNA, 60 nt, Human
guuuccugacccuggcccagcagguaggauugcuggcuauguuaucuaggccuaggaagc

SEQ ID NO: 4198606 - RNA, 56 nt, Human
guuuccugacuguggaauuauauugagugauuggacugauugcaguucaggauaac

SEQ ID NO: 4198607 - RNA, 66 nt, Human
guuuccugcccugucuuauccagacauuuucaucccccuuuuucuggccuagaccaguaagggaau

SEQ ID NO: 4198608 - RNA, 57 nt, Human
guuuccuguggccacagaauaaacgaaacuaacuguccuggggcuucuucaggaaac

SEQ ID NO: 4198609 - RNA, 88 nt, Human
guuuccuuaauuugauagauucuuuacucagauuuuguuauugcagauuauggaauauuaaaguaaaaguaaacaaaaagagagaagc

SEQ ID NO: 4198610 - RNA, 64 nt, Human
guuuccuuugccaguaaauggggauaugauccccuacaauauuauaguggaaauuaaaggagau

SEQ ID NO: 4198611 - RNA, 75 nt, Human
guuucuaacaugcuaauuugcagauagcagaguaauuauaauucuccucuuugucauagcauaguaaauuggagc

SEQ ID NO: 4198612 - RNA, 76 nt, Human
guuucuacaagauaauuuauucugaguuucaacuaaacaaugaccuuggaauaugucuguuuuguaaauuugaaac

SEQ ID NO: 4198613 - RNA, 55 nt, Human
guuucuaccuuccugauaacuggugaauucaccaugguaacaguugaguagaaac

SEQ ID NO: 4198614 - RNA, 123 nt, Human
guuucuauaguuuuggagauacaugagucacccugcagggcuaauggggcaaguaggcugcccuacuuauucuuuuggcuuaugaguuugauaauggaagugaaaauugagaauugaagaaau

SEQ ID NO: 4198615 - RNA, 64 nt, Human
guuucuauuaugguacuuaucaugauacuguuuaucaugcuuuuauaguuuuauaguggagcac

SEQ ID NO: 4198616 - RNA, 69 nt, Human
guuucucagcaugucaguacaaccauaaguuccuugaagauagggaauguauuccaaaaugcugaggau

SEQ ID NO: 4198617 - RNA, 64 nt, Human
guuucuccaauuuccuugucaggaaggauugcuagucaucuugaaaauugagguugaaggaagc

SEQ ID NO: 4198618 - RNA, 70 nt, Human
guuucuccucugugucuuguuuaacuuuucguguuagcgaaauucacaaauuugaccaaggaaccggagc

SEQ ID NO: 4198619 - RNA, 72 nt, Human
guuucucgcuauagcaagcuuugagcuuucagagaacuuauauuugaaaacuggaucuucuauggcagagac

SEQ ID NO: 4198620 - RNA, 67 nt, Human
guuucucuccuuagaggaggcaagagcucacuagucuuucaauguaugucuuucugaggagugggac

SEQ ID NO: 4198621 - RNA, 63 nt, Human
guuucucuuuggacuuuuucccucuuguaaauugauacugaggguaugaagccaaggaagaac

SEQ ID NO: 4198622 - RNA, 70 nt, Human
guuucucuuuugugaugugagaugggcgucuuacuccagugcugcaacauguucauuacagaggagaggc

SEQ ID NO: 4198623 - RNA, 58 nt, Human
guuucugaacaguacuuggccaguuucuuuaacaggagauggcuuugcuuuuagaagc

SEQ ID NO: 4198624 - RNA, 72 nt, Human
guuucugagggaugcagcugugugccagagguaccgagaaaugccccauacacaugcauguacuccaggagc

SEQ ID NO: 4198625 - RNA, 64 nt, Human
guuucugcagcggagaaagguuaugcuucauaugacuucguuuucucucugcaaauuaagggac

SEQ ID NO: 4198626 - RNA, 104 nt, Human
guuucugcugaguuggcuguucuguuauauagauaauguguguguguguaugugugugugugugugugugugugugugugugauguacauuuaauucacaaaac

SEQ ID NO: 4198627 - RNA, 130 nt, Human
guuucugugguuacuuggccuccuuuccuggaggacagcacaggcaggggaacuauaggugugauccaccuauagaucccccguaugugugauaaagaggaaaggcagugauaaggccuggacccagucc

SEQ ID NO: 4198628 - RNA, 69 nt, Human
guuucuguugcucagauaaugcagucucaucucgucugugauuucagcagcacucauggcaaugggaac

SEQ ID NO: 4198629 - RNA, 114 nt, Human
guuucuugagucauaggaagcugcucuccauguguuacuuucaggguaguuaagguaauuuaaugcaaaugaccuuaaaacugacacauggagagcagcuaugacucaagaaac

SEQ ID NO: 4198630 - RNA, 60 nt, Human
guuucuuggccuuucuauagcagaguggcuggauucugaaagggagaacaccaagagcac

SEQ ID NO: 4198631 - RNA, 58 nt, Human
guuugaaaccuaugugugcugacaucaccacugggcugggacacuguagauuucaaac

SEQ ID NO: 4198632 - RNA, 66 nt, Human
guuugaacaaccuggccccagauuccccaucugugaaggggcacugaggcuaggucguacuugggc

SEQ ID NO: 4198633 - RNA, 63 nt, Human
uaagagcaaaaggucuguauuagaguuucauccuuauaugaaauuuugcagaucuuguuuuug

SEQ ID NO: 4198634 - RNA, 98 nt, Human
uaagagcuaauugcuuaaaugaccagaauacaggcuuccaagcugaucuuuguagaaaggccaaggcaagccuguaucauuuaaauuuuaguuacuua

SEQ ID NO: 4198635 - RNA, 93 nt, Human
uaagaggaggagauuggaaggaggggcaaagcaguucauggggaucccuggaacugaguccagcucauccaaagcuucuaucuucugcuuuua

SEQ ID NO: 4198636 - RNA, 64 nt, Human
uaagaggggaguccuaaucugauucaccuugaguggggaagaucaguaaggacuuuaauucuua

SEQ ID NO: 4198637 - RNA, 55 nt, Human
uaagagguugcuuggcagcauaaggagacacuugagcuucaaagccauccuuuua

SEQ ID NO: 4198638 - RNA, 97 nt, Human
uaagagucuuauuuggaagucgggaaagcaaaauugauuucacaaaauagggacaaacugacauggauuaaggcucccauuuccaauuaauuucuua

SEQ ID NO: 4198639 - RNA, 84 nt, Human
uaagauaaaccuguaauucuuguucagagguaguaagcuguaggucggguuauugaagaacagagaauuauuagguuucuuuug

SEQ ID NO: 4198640 - RNA, 76 nt, Human
uaagauaugacagcucuagcacacaguagguacucagaaaauguuagccucugugcuggacugauuucauauuuua

SEQ ID NO: 4198641 - RNA, 102 nt, Human
uaagauguuugcuggagaaaccuauuguuuacugaaagcacucaaugaagucaaauuacugaagcuuuugccuacaucuuggucuuuuauguaaauauguua

SEQ ID NO: 4198642 - RNA, 72 nt, Human
uaagcaacugucugucaccaaaacagacucuucucacuaguguuuacagucuaguuggugagacagagcuua

SEQ ID NO: 4198643 - RNA, 59 nt, Human
uaagcaggcugugguauguugggcaaaguacaaaaugccucucagccacaguuuccuua

SEQ ID NO: 4198644 - RNA, 115 nt, Human
uaagcauuauaacuuaaccuaaagaauggcuuuggcaggaauuucaagcacagacagacuugauauuccucccaaagccguucuuuagguuaaguugguaaaaaagagaugguua

SEQ ID NO: 4198645 - RNA, 130 nt, Human
uaagcauuuuauccaaguacaaauguuaaaagcagaguaacuuaagcaauuguguauacaaagguauacagacacuguagguuauuuuucuucuugaaucauuuuugcugcauaguaaauugcaauuaca

SEQ ID NO: 4198646 - RNA, 70 nt, Human
uaagcccacauuuuucugaagacucuaccuaugauuuuuaaauauaggcuucuuggagaggguggacuua

SEQ ID NO: 4198647 - RNA, 62 nt, Human
uaagcccuauuaugcaaauauuccuaccugaguagaaaccucaggaggcaugaggggauuua

SEQ ID NO: 4198648 - RNA, 72 nt, Human
uaagccucugacuaacguaacucuuaaguuuugcucagcaauugcauugagagugacuuggacaauuaauua

SEQ ID NO: 4198649 - RNA, 108 nt, Human
uaagccucuuucaauuaugguaaguagucuauuugcaugugucuaauccagaugucugccuauauggauaaaugugcagaugacaugcuauguuuguuugcuugcuug

SEQ ID NO: 4198650 - RNA, 96 nt, Human
uaagccuggagcugaggggccucuggggagcagcccuggugaguugggucaccucauuucaugagggccagcccucggggaggcuccacaggcuua

SEQ ID NO: 4198651 - RNA, 82 nt, Human
uaagcucugcaggcuuauaggaugggugugucaggcaucauuuaggggacagacccaagucaucuggcuuguuuagagcuua

SEQ ID NO: 4198652 - RNA, 57 nt, Human
uaagcugaaagugcuuugaggacuaguacucuaucuuauuugucuauuuucagcuug

SEQ ID NO: 4198653 - RNA, 100 nt, Human
uaaggaaaaggcaggcagcugcuggguucagccugugggagaaaacaaccuacaaagugcucggugaacucaucccucagcugcagcgucuguuuccuua

SEQ ID NO: 4198654 - RNA, 73 nt, Human
uaaggaaagcacagagcucccacaggaaaccuuuuauaucucuggaguucugugacaucuuuggcuuuucuug

SEQ ID NO: 4198655 - RNA, 130 nt, Human
uaaggacagccugcccccuaggcuggccccuuggggaggaugcaggcugcuuccaggaggugcccuaugccaccccucagagccaugccugaguucugcugccagccccuccggcaggagguuggccuug

SEQ ID NO: 4198656 - RNA, 90 nt, Human
uaaggauauucccuuuuagcauuuggcaccaguuauuuuacaccaacuugugaagcacagugccaaguucuauugccuggaaucuccuua

SEQ ID NO: 4198657 - RNA, 57 nt, Human
uaaggcugauuagacugauagcuuuuauaauucaaggcuaaccagcuaacaguuuua

SEQ ID NO: 4198658 - RNA, 95 nt, Human
uaagggagaagagguuuuuggagugaggcauugaagaccggaauagagguuaagucacccaaugccuuauuuugggauauuacaauuuucuguua

SEQ ID NO: 4198659 - RNA, 81 nt, Human
uaagggugguccaugucgauaggagugccaucggccaggcccaccgaggucaucccacuccucuccacaaucacgcccuug

SEQ ID NO: 4198660 - RNA, 80 nt, Human
uaagguccucauuguguacauguaucaacuaucguuuucaaaugaaauagacacagugcuauacagugcuuuaaaccuug

SEQ ID NO: 4198661 - RNA, 65 nt, Human
uaagguuaaccaaggcaccaaguguacuuuuacaaggucacuguugaacccucuugguggcuuua

SEQ ID NO: 4198662 - RNA, 61 nt, Human
uaagguuaccuauaaugggaagucucuaccuguaucaugguacugccuuuagguauccuug

SEQ ID NO: 4198663 - RNA, 59 nt, Human
uaagguuuggcugucucuugguuccuauuugaaugccacauugagacagucaaaguuug

SEQ ID NO: 4198664 - RNA, 83 nt, Human
uaaguaaauucuguuucacaguauuuguuuuucugaguguacauaauuucacucuuuuaagaacugcugauagaaguuacuua

SEQ ID NO: 4198665 - RNA, 82 nt, Human
uaaguagggugaguaaagguagagaauaagguggugguauuugagguacuuugauaagguucuucuauucuuaccuaacuua

SEQ ID NO: 4198666 - RNA, 77 nt, Human
uaaguauuauaaauaugugcaugaaaaugcaauuugauauuguauuucgaugcacguguaguuuauauuguugcuua

SEQ ID NO: 4198667 - RNA, 66 nt, Human
uaagucaggaaauggacaucuuugcuguuugaccgcugggcagagaaauaaucauuuccuuccuua

SEQ ID NO: 4198668 - RNA, 66 nt, Human
uaagucaggaggucuccugacacuuugccuuuugauaaggaacagucagggguacuuuuuaacuua

SEQ ID NO: 4198669 - RNA, 70 nt, Human
uaaguucaucucacagauaggcaguuucaaauacucuguacuuggaaacuguuucuugaaauagaacuug

SEQ ID NO: 4198670 - RNA, 71 nt, Human
uaaguuccucuucucugcagggaacauugggagcuccuuaccaaauuccuggucagcagaagaguaacuug

SEQ ID NO: 4198671 - RNA, 61 nt, Human
uaaguucugacucugaaucugggaauguggucaccuuccucagagacaaguugagagguug

SEQ ID NO: 4198672 - RNA, 90 nt, Human
uaaguuugacccucuuaacuguauagcuuggacuaaaauucaaaauguaagcuguuuuauucaaaugcaguggggucacuaauugauuua

SEQ ID NO: 4198673 - RNA, 60 nt, Human
uaaguuuuuauguuuuagcugugaugacugaagucaugaugcuuuaguucaaaggacuua

SEQ ID NO: 4198674 - RNA, 95 nt, Human
uaauaacacacuuaacauaaaaaggacagauguggucuucuauuaauaaaaugagagacuugccugcucuuguuuugggauuaaauguuuuauua

SEQ ID NO: 4198675 - RNA, 88 nt, Human
uaauaacuuuucuaaaacauccuaccuacaaucuugugugcaaauugguggcucaauucugcaacuguuguuggugguguuguuguua

SEQ ID NO: 4198676 - RNA, 66 nt, Human
uaauaauaaccuuggcuguuauugugccuuuccaucaaggcacaauacuagccaagguuauuauua

SEQ ID NO: 4198677 - RNA, 94 nt, Human
uaauacauacggagaaaccugaauguaugucagaagcaugugaucuacauuuguuugcuuucguuuuaaauauucaugguuuccgaauauauua

SEQ ID NO: 4198678 - RNA, 72 nt, Human
uaauaguauugagagguggggccuuuaagaggugauuaagucaugaaggcuccacccucauggaugcgauua

SEQ ID NO: 4198679 - RNA, 74 nt, Human
uaauaucugcuugaguuugaagucaggaauuugccaaacaugggcucugaugacggauuucagcaugaggguua

SEQ ID NO: 4198680 - RNA, 62 nt, Human
uaauauggacagaguggugguugagggugccggcucuggcaucaaaccacuuugccaaguug

SEQ ID NO: 4198681 - RNA, 62 nt, Human
uaaucagaaauucuacaucacaauggcucagaauuuugucauaggauguuugcuuuugguua

SEQ ID NO: 4198682 - RNA, 94 nt, Human
uaaucagcacgugacgagcacagaaaaaaauucacagugaauauuugcugaguaaacacgugggguuucuuuccaugcuuuucaaggcugauug

SEQ ID NO: 4198683 - RNA, 94 nt, Human
uaaucaugcaaaccacuaaauguuucaaugugggagggagaaaacauuaccauuuaaacucucaucauauuuuuauuuacugacugcaugguua

SEQ ID NO: 4198684 - RNA, 83 nt, Human
uaauccaccacagggagcggagucccaugccuugugguucuuuucaucccuacuuagguaauugcucagcucccauuggguua

SEQ ID NO: 4198685 - RNA, 55 nt, Human
uaaucccuagaguugagcaaauaaaccaugucuggccaaucagcuauagggauug

SEQ ID NO: 4198686 - RNA, 62 nt, Human
uaaucuacuguuuauaugaaaugucuggaacaggcaaacccauagagacagaaauuagauua

SEQ ID NO: 4198687 - RNA, 56 nt, Human
uaaucuagucccacauggaauucacugcaaaugauuucuaaaugugggcaggauug

SEQ ID NO: 4198688 - RNA, 58 nt, Human
uaaucugaccucccagugauagauuuacuguuucuacuuagucaccuggaucagauua

SEQ ID NO: 4198689 - RNA, 122 nt, Human
uaaucugcaaaucuguguaucaucaugagauaaagcaaauaggacuauugcauuccaauucuguacagucuucuuaaugcuuuucauccucugugauuuauauuauucaagauuucauauug

SEQ ID NO: 4198690 - RNA, 57 nt, Human
uaaucugguugcucugagaauaguuuggguccaaaucuuauuucaguugcuagauug

SEQ ID NO: 4198691 - RNA, 67 nt, Human
gugcaauccaguugauuuuuacauugaaaggucacaguucccccucugagagucugacggauuguac

SEQ ID NO: 4198692 - RNA, 91 nt, Human
gugcaauggcuaggccacugguucugauguucuuggcuucuuccuuauggucacaagauggcugcuucaguaccaguucuuauaucugcau

SEQ ID NO: 4198693 - RNA, 78 nt, Human
gugcaaugucugggucacagccagagaaagggcacugccagaggcauguuuauugcucuugcuggccaaacauuccau

SEQ ID NO: 4198694 - RNA, 85 nt, Human
gugcaaugugcauuauugaaggcccuguggacagcugggauagcccagugaugcccaagggccuagucaaaaguggacaaagcac

SEQ ID NO: 4198695 - RNA, 62 nt, Human
gugcacacaagcacaugcauacauaccugcacauacaugcacacacgugugcuugugugcac

SEQ ID NO: 4198696 - RNA, 87 nt, Human
gugcacacacccucagaggaccuguguggccagagccuucuaaauggugagcuggauaccaggguucuugacuugggucuguugcac

SEQ ID NO: 4198697 - RNA, 57 nt, Human
gugcacacauacaugaacgcugcacacaggugugcacgcucacacacgucugugcac

SEQ ID NO: 4198698 - RNA, 62 nt, Human
gugcacagaaauugguaagacuuguaaaaccuugguuuaccaggucuggugaugucuugcau

SEQ ID NO: 4198699 - RNA, 97 nt, Human
gugcacagcagacucagcaguagggccaggagggaggcucugggguaguguggaauccccggcuccuccgcccuugcucacgcacaccuguuuucau

SEQ ID NO: 4198700 - RNA, 63 nt, Human
gugcacagggaccugugagcuccauagacucaucugggaagaccugcuccagucccuccguac

SEQ ID NO: 4198701 - RNA, 75 nt, Human
gugcacauaggucauagguagaauaauaaaacucuagugucauaauuauuuuaugugcggccugauuuaaugcau

SEQ ID NO: 4198702 - RNA, 68 nt, Human
gugcacaugaaaguugggggcuauaggccugaugggggcucaggccaaacccagcucucguggugugc

SEQ ID NO: 4198703 - RNA, 55 nt, Human
gugcacccccaaggagguggagcauaauucuccccuccuuaaauaugggcugcac

SEQ ID NO: 4198704 - RNA, 64 nt, Human
gugcacccugggauuuccacagccacguggauuuuaagccaaauccaggaugaucccaugacac

SEQ ID NO: 4198705 - RNA, 125 nt, Human
gugcacuccaucuaggguaccaaccaucucagugugcccgagacugauggggcucccagaaggcaagacuuucagugcuaaaaagucucaagcaaaccgagaugagucacucgcuggcugugcau

SEQ ID NO: 4198706 - RNA, 101 nt, Human
uaacucuucucuguguuuuguccauuucaaaugauaugugcccuaguuuggguucacuagaaacagauguuuuugaagaaucagacacacaagaagaauua

SEQ ID NO: 4198707 - RNA, 76 nt, Human
uaacuggaucauauaucaguacucuccaagugccccucacuggaagugcuaaacuggagugugauucucagaguua

SEQ ID NO: 4198708 - RNA, 129 nt, Human
uaacugggauggguguuggaguaugggggauagcauaggaaaguacugggaaccgucaaucagucgcgguggccuugagagaucaaaaggugcugaaagcccccugcccgcaaaacacaccucuaguua

SEQ ID NO: 4198709 - RNA, 106 nt, Human
uaacugugggugugguuauuugcauaugaagcugacuuaaauaggugagaugucuacaaaguuuuaaggagaguuuuacugccaaaauaaccauaagcuuggguua

SEQ ID NO: 4198710 - RNA, 64 nt, Human
uaacuucucugggacaggaacaguuuaagcuucuguuuacacugucauuucucgggcaaaguua

SEQ ID NO: 4198711 - RNA, 78 nt, Human
uaacuuucccuauguucucuccagcaaaguaacuuuacauuguagcugaaggcuacagcagaacaaagguagaaguug

SEQ ID NO: 4198712 - RNA, 67 nt, Human
uaagaaaaggucuacaucacugaaagaccuugaguugaguguuuuuguguguguuagauuucucuua

SEQ ID NO: 4198713 - RNA, 96 nt, Human
uaagaaauccugaguaauauguaaaugguugugacauucccuuccucugauaaagaaaugcagaaaggcuucacuuauuuauuuuagguagacuua

SEQ ID NO: 4198714 - RNA, 86 nt, Human
uaagaaauucauaguaauggaugugcuaagggaguauaaaguaaaauaauuuaauacugacuaaagauaucaaaaugaauuuuuua

SEQ ID NO: 4198715 - RNA, 121 nt, Human
uaagaagaaaugauuagguaaaaugaagcauguuuccagaccuuaugacauaaauuuuaucuuaacaugaaauaggaaacagauguuucuccuccuuugcuugcaguauuuuccucucuua

SEQ ID NO: 4198716 - RNA, 93 nt, Human
uaagaagacagggcuccaaggaaguguagcuauuuguccaaagucacaauaccauucaguggcuaagcugugacuuggacccgagucugauua

SEQ ID NO: 4198717 - RNA, 68 nt, Human
uaagaagacuugcuucaagggcucucuucuaccaugaauuagcuggguggccuuaggcaagucacuua

SEQ ID NO: 4198718 - RNA, 85 nt, Human
uaagaagugccuaaguuuuucaguucuguacaaguccagagagcaaacuuauuuguggcugucgagaauugagggucucuucuug

SEQ ID NO: 4198719 - RNA, 72 nt, Human
uaagaauacacauuguauguuucugugcacaugacagugugugugugugcacguacauacuguauagucuua

SEQ ID NO: 4198720 - RNA, 80 nt, Human
uaagaauacagaucucugggcacaugccagaagguuaaauuuggcagaggcugggguuugcucaguucucuguauuuuua

SEQ ID NO: 4198721 - RNA, 65 nt, Human
uaagaauaguaguugaagcaggugaauauggaggaauaacucuucccuucuccagcuuguucuug

SEQ ID NO: 4198722 - RNA, 65 nt, Human
uaagaauauugggaauggaugggaaaagacccugaaggcucaaaucaucuguauuccuguucuug

SEQ ID NO: 4198723 - RNA, 87 nt, Human
uaagacaggaaaacauaguggucaggcuuuggacucuccacucauucuucccaaguucaaaucccugcuccacuauuuccuaucuug

SEQ ID NO: 4198724 - RNA, 60 nt, Human
uaagaccauacauuuccacagauugcuuugccugcuguauaaugagagugugugcucuug

SEQ ID NO: 4198725 - RNA, 75 nt, Human
uaagaccaucaggcugauaggaggaacugauacuaaauagaguuaucagugacucagauguagucaaguggcuug

SEQ ID NO: 4198726 - RNA, 72 nt, Human
uaagacuauacaguauguacgugcacacacacacacugucaugugcacagaaacauacaauguguauucuua

SEQ ID NO: 4198727 - RNA, 88 nt, Human
uaagagaaagugacuugaggcaaggcugaaugaaggcauaaaucaagcgaugcaggccucauuggucuugcuggggauuuuugucuug

SEQ ID NO: 4198728 - RNA, 63 nt, Human
uaagagaagucagggucugcaccaggcacagcccaacaccagguacagccccugcuucuguug

SEQ ID NO: 4198729 - RNA, 69 nt, Human
uaagagcccaguucuauauuguguuuaauggcaaacguccaugcaacacaaagaagcugcaggaucuua

SEQ ID NO: 4198730 - RNA, 62 nt, Human
uaagagcuaggauuuuaaaucagccaauguugauaaaguugauuguaaaauguugguacuua

SEQ ID NO: 4198731 - RNA, 72 nt, Human
uaagaggcaaaagauacucagauuucugccucaauaauaauuugguauuuauuugaguguuucuuccccuug

SEQ ID NO: 4198732 - RNA, 79 nt, Human
uaagagguaagguauagugaacaagagcaaggaccuagaaacccaaccauccugaguucaaguuaugccuuuacccuua

SEQ ID NO: 4198733 - RNA, 75 nt, Human
uaagauacaacgcuagaauagccaggagaacauccuuagugaaauauagggagccauggcauuuuaugugucuua

SEQ ID NO: 4198734 - RNA, 67 nt, Human
uaagaugaggaugguuaaagaacauuguuuagaaauaggcaaguucugcgcugauuauccuuuuuua

SEQ ID NO: 4198735 - RNA, 78 nt, Human
uaagaugcagaugccugggcugcaccacccuuugagacuuuaagcaggucauggugggguccaggaaucugcauuuua

SEQ ID NO: 4198736 - RNA, 71 nt, Human
uaagaugggcucaaacuggagguuguuugaaaauuuaaaaucaaacugcucuuaccagaugggucagcuug

SEQ ID NO: 4198737 - RNA, 56 nt, Human
uaagauguggaaucacagcuucagcucaggcagcgggaggcuggaugcccaucuua

SEQ ID NO: 4198738 - RNA, 89 nt, Human
uaagcaaacgacauagccuggcugggccugauuucucaucuauaaaaugggaauggcaccaccggguuugagaauuguguugauguuua

SEQ ID NO: 4198739 - RNA, 79 nt, Human
uaagcaccaaggagccacauacaaccuagaccuucacaaauuaauuccuauugcuacuggucuccuuggccucugcuua

SEQ ID NO: 4198740 - RNA, 57 nt, Human
uaagcacuuuauaugcuuuaucuaauuagcuauucuugaagcccugugaggugcuua

SEQ ID NO: 4198741 - RNA, 56 nt, Human
uaagcauuaacucugcugcaaggucuguauuuuaacuuugugcagaugugugcuua

SEQ ID NO: 4198742 - RNA, 120 nt, Human
uaagccaaggaauccaccuugacuuauaaugguuaaauggguuaacccauuuaagauugugaaccuauaaaugugguuaacccauuuaagauuuggaagggugguagauucuuuggcuua

SEQ ID NO: 4198743 - RNA, 63 nt, Human
guugcuaaugauuccugaucuccugucaccggacaccuuguggcaugacagugaaugggcagc

SEQ ID NO: 4198744 - RNA, 72 nt, Human
guugcucaagaugguguggucaaggaccaacagcaguuggcaucaccuccacgaucaucuggugauaguaac

SEQ ID NO: 4198745 - RNA, 110 nt, Human
guugcuccaucucuaagagacucaggucuacaggccacugauagccaggcugcccagcucuaagcacugagcaugagugggcuguggggucauauuuggagcaaagcaac

SEQ ID NO: 4198746 - RNA, 129 nt, Human
guugcucgggagccuguuggcaccuuacaaggccugaguucuuuggugugugagagaagaguuuguuguuguuguugguuuucacccacuagagaacucagggugcaacaacuaggcuaccuuggggau

SEQ ID NO: 4198747 - RNA, 57 nt, Human
guugcucucugguuucgcaggaaauagauuguucuaaucuuugaaaucagggucaau

SEQ ID NO: 4198748 - RNA, 57 nt, Human
guugcugagagacagaguggaaugguauuuccauuuuucuaacucucagaauccagc

SEQ ID NO: 4198749 - RNA, 110 nt, Human
guugcuuaaucguauuccauuguauggagaugacacaauuuauuuauccguuuuccuauggauggacauuugaguuauuuccaguuuggggcuuuuacaaauagagcagc

SEQ ID NO: 4198750 - RNA, 61 nt, Human
guugcuucuccucucugacccucugucuccuucucugucuggugggcuuagugagagcaac

SEQ ID NO: 4198751 - RNA, 77 nt, Human
guugcuuuggguguuuuagucuuuaugguauguaugugugguuuauauauacaacuagauuaaaagauucucaagac

SEQ ID NO: 4198752 - RNA, 96 nt, Human
guugcuuuucuuauuuggcaaauggguuuuuguacuuuacgucugucugagguuuauaauaugcugaggucauuuccaagugauuuuucaagugau

SEQ ID NO: 4198753 - RNA, 91 nt, Human
guuggaacaugauuucucugauggauaauuagcuguuuucaggacuccuccuauucagcugaauguucucagaccagaagucugaucuggc

SEQ ID NO: 4198754 - RNA, 59 nt, Human
guuggaagaagacuguaaauuaugcuaauuauaaagcccgugaaugaucaucuuccagc

SEQ ID NO: 4198755 - RNA, 55 nt, Human
guuggaaggagccuaaaagagaccuugagaaaaaaagguccagacuucuaucagc

SEQ ID NO: 4198756 - RNA, 95 nt, Human
guuggaagugcauccuuaaccagcaucacuucagaggugcuuuaacuggaacagcacaaaauaguucaguguugguuaagaugaugauagcugau

SEQ ID NO: 4198757 - RNA, 76 nt, Human
guuggagaugugccugagggaguaagacacuaucuuacaacaacaggacucuuacucccucaggcacugcaccagc

SEQ ID NO: 4198758 - RNA, 55 nt, Human
guuggauuucaugcaguaaaguaccaauacagugagguugcugccaagucccaac

SEQ ID NO: 4198759 - RNA, 61 nt, Human
guuggcagcaagaccaccccuggacaaaaagccgaucucagggcaggucucugaugucaac

SEQ ID NO: 4198760 - RNA, 95 nt, Human
guuggccaggcuggccucgaacuccugaccuugugauccacccgccuuggccucccaaagugcugggauuacaggugugagccaccacagccgac

SEQ ID NO: 4198761 - RNA, 64 nt, Human
guuggcugcuccucagcugugcuguugaaagaugucagaguaguuuaguaagaggagagcugac

SEQ ID NO: 4198762 - RNA, 94 nt, Human
guuggcuggaggccucaguuucuuaccacuuggaccucuuuacaggcuugcuagaguguccucaugguggggcagcuggauuccuccagaugac

SEQ ID NO: 4198763 - RNA, 90 nt, Human
guugggccucucuucugcagucuccuuacuccgcaugugcacuggugguguaugcagagugggagaggugcgggcucucuggggcccagc

SEQ ID NO: 4198764 - RNA, 60 nt, Human
guugggcugaagugugugcuuauaaauguguuuaguuuuuaagcuaaacauucaguuaac

SEQ ID NO: 4198765 - RNA, 60 nt, Human
guuggggaggagauugaacauugccugugauugauagguaaguccaccucauucuucagc

SEQ ID NO: 4198766 - RNA, 57 nt, Human
guuggguaauuaagcacagaaauguucugggacaugcucugugugccaucaccuaac

SEQ ID NO: 4198767 - RNA, 63 nt, Human
guugggucagagcagagcuggaaucugccucccuggaucucgugcuucucugcucuacccggc

SEQ ID NO: 4198768 - RNA, 62 nt, Human
guugguacaugaacuuggucuuuuuaggucuauauccugucaguccagaguaaugugcugac

SEQ ID NO: 4198769 - RNA, 75 nt, Human
guugguauggugggaagagcuuggacuuucaagucagucaucuggauuugaauccuggcuuuaccacuuaccagc

SEQ ID NO: 4198770 - RNA, 99 nt, Human
guuggucaggcuggucucgaacuccuuaccuuaugauccaccugccuuggccucccuaagugcugggauuacaagcgugagccaccaugccuggcccac

SEQ ID NO: 4198771 - RNA, 72 nt, Human
guuggucauuuuaaacuagugaaguguaccuaaaauuuaaggaaacacuuagaauuaguguagaaugaagac

SEQ ID NO: 4198772 - RNA, 72 nt, Human
guuggugcaaaaguaauugcagguuuugccauuaaaaguaauggcaaagacugcaauuacuuuugcaccaac

SEQ ID NO: 4198773 - RNA, 56 nt, Human
guugguggaugugggcagagcaggauuaguuccuuucuucugcccucucuucuagc

SEQ ID NO: 4198774 - RNA, 56 nt, Human
guugguggccccugggagaugcuggcccgggagccaggggcuagggggccaccagc

SEQ ID NO: 4198775 - RNA, 71 nt, Human
guugguuggcaauguuucgaugggagcugucuuuucacaggaugguucacuuaaguaaacggucaacuggc

SEQ ID NO: 4198776 - RNA, 98 nt, Human
guugguuuaguuguggcauuuuagaacagcugacuugggacuaaagcaucuuucuaucugggaucaguauuucuaaguugccuuuaagcugaauaaac

SEQ ID NO: 4198777 - RNA, 59 nt, Human
guuguaacgcuaguaucaccaggcuaaguuccuagccaggucacacuguguguuaaagc

SEQ ID NO: 4198778 - RNA, 76 nt, Human
guuguacagcauugugucuucacucagcaaugagcaugugcuuucagcuggguuugacaucaauacaccugacaac

SEQ ID NO: 4198779 - RNA, 62 nt, Human
uagaauucaggcuuaugcugaauaauucuugggagaaauucagaaagauaugccugguuuug

SEQ ID NO: 4198780 - RNA, 55 nt, Human
uagaauugggccuaacuuccaucuauaguacuagaugaucuugggcaaguuacug

SEQ ID NO: 4198781 - RNA, 57 nt, Human
uagaauuguuguacagaauaaaugagcauuugaugugcucauuacagaguaguucua

SEQ ID NO: 4198782 - RNA, 105 nt, Human
uagaauuuauuucuuguaauaguaaccaauuaaacuaguuaccaguuggagagcauguuccagcacuuaaguuaauugaacuguugcaaacgaaauaugauucua

SEQ ID NO: 4198783 - RNA, 83 nt, Human
uagaauuugacaugucugauaaauaaugcauaaguucaauuuagcauuuaaugagcuagguacuguggggcugucacuaucua

SEQ ID NO: 4198784 - RNA, 68 nt, Human
uagacaaucucagcaaacacacacacuggagacuuacugagugacucaauguuggcuagaauugucua

SEQ ID NO: 4198785 - RNA, 92 nt, Human
uagacaauggggaggaguuguucugcaggagagaaggggacaguccuuccuccagccuggagcacuuccugcaccgcuccccaccccgucua

SEQ ID NO: 4198786 - RNA, 101 nt, Human
uagacacucauucauccagcaaauauuuacugagcagcuauuacucuccuaggugccgugggaugcaguggugaguggcaagaauggauagaugaagucua

SEQ ID NO: 4198787 - RNA, 58 nt, Human
uagacacuuauuuagugggaguuaagaucuuuuaaccucauuuccaaguaggugugua

SEQ ID NO: 4198788 - RNA, 65 nt, Human
uagacagaauccagcccacgccuguagcccuaaugcugcccugacguggucuggauuuggguuug

SEQ ID NO: 4198789 - RNA, 78 nt, Human
uagacagcuugggauagugaaacuuggguuguguuuuagaagaaacuggaucugaacaucgguaucauaaacuguuua

SEQ ID NO: 4198790 - RNA, 63 nt, Human
uagacaggguggcuuagaaacaacagaaguuuauuucucacaguucuagagacuacaggucug

SEQ ID NO: 4198791 - RNA, 71 nt, Human
uagacagugggaagagaaaugagucaagacuugagccuuucagcccuucucucuucucauccaaauguuua

SEQ ID NO: 4198792 - RNA, 87 nt, Human
uagacaucaguuuugaaauacugaugaaauacucucuacucuccucagugaugaguauuugaucagaugauaguaauuguguguuua

SEQ ID NO: 4198793 - RNA, 129 nt, Human
uagacaugcaauuggccuaacaggcagaugaguuaauuuauugguuuuuagcagugaguugcauuaaugacauuacugaugaaaacuaauaaauuaacucaucuaccuuguaagccaacuccacaccua

SEQ ID NO: 4198794 - RNA, 66 nt, Human
uagacauuggccauuccuguggcacugugcauugggcacaugaugccacgggaaugccuaguucug

SEQ ID NO: 4198795 - RNA, 75 nt, Human
uagacauuuauucauuuuuugagugccuacuucuuaccugcguauuuggggcacaaagaugaauacagaaugcug

SEQ ID NO: 4198796 - RNA, 59 nt, Human
uagaccauucuauuuccuaugcgguggugauauucaaggcaggggauagaaauggucug

SEQ ID NO: 4198797 - RNA, 69 nt, Human
uagacccuggcuagggcuuaaccuggcucugacuagaccuaaauuaggcuuaggcccuggcuagggcug

SEQ ID NO: 4198798 - RNA, 56 nt, Human
uagaccuagcagcgucucccaccagccucuacuguguuggcuugccuguuaggcua

SEQ ID NO: 4198799 - RNA, 71 nt, Human
uagacgcuauaaaggaaugaaaaggaugucuggaauuugucagguucuuaacuuguucuuccuagcuucua

SEQ ID NO: 4198800 - RNA, 107 nt, Human
uagacggguggcuuaaacauagaaauuuauuucuuacaaugcugggugcugggaaguccaaaauaaaggugugggcagaucugguuucuggugaggcccacuuucug

SEQ ID NO: 4198801 - RNA, 84 nt, Human
uagacuagaguggcucuuugagacugaauuaaaauguuugaacuuuguuacaugcagugaggaucuuagaaaucaccuugucua

SEQ ID NO: 4198802 - RNA, 78 nt, Human
uagacuagaugugguauauuagaagcagccaacaacuuuuucaggaauuucuaguucuaccacaguaauguagaccua

SEQ ID NO: 4198803 - RNA, 75 nt, Human
uagacuagcagugacugucauucuagugcccauggcuaaauggcugugggauacgugugacauacaaguuagcug

SEQ ID NO: 4198804 - RNA, 68 nt, Human
uagacucccuauauucacaccuguugcaaagugacuuugcaguucuccagaauaaaggguggaguuua

SEQ ID NO: 4198805 - RNA, 58 nt, Human
uagacugucuacacagaaacggucagauucacaggugugaccucugcagagauguuua

SEQ ID NO: 4198806 - RNA, 64 nt, Human
uagacuguuaccuauauuuaugugcccuguugggacuugcauauauuuguugguggcaaaccua

SEQ ID NO: 4198807 - RNA, 82 nt, Human
uagacuguuuugcucuggggccugaggauugcggggccagggaagcaaccaggcccagucuggggcccugugaagcgaucug

SEQ ID NO: 4198808 - RNA, 91 nt, Human
uagacuuuggcccagugaugauagggguaaaggaggaaauuuacuaugguaaauucccaacucugcucuucuuugcuaaauccaaggugua

SEQ ID NO: 4198809 - RNA, 78 nt, Human
uagagaauuggaggcaccuuguuuucacaacuaggauaaaaauagguguugauucuugcaggguccuuuccauuccua

SEQ ID NO: 4198810 - RNA, 98 nt, Human
uagagaauuguguuuguguguguguguaucuauguauguguacuuuuaauuuugguaguauacugaaaguaaauaugacaaacaaauacccuuugcua

SEQ ID NO: 4198811 - RNA, 67 nt, Human
uagagacacaauagagucaguucuacauucucacugaaaugaagguacaagaacaggcuuuacucua

SEQ ID NO: 4198812 - RNA, 62 nt, Human
uagagacacuggcuggauugaggaguagaaggcucaaacaacccaagguuaguuggucuuug

SEQ ID NO: 4198813 - RNA, 109 nt, Human
uagagacagggucucacuaugcugccgaaacucaccuuuaucauauuuuugaaggauauuugucuuucacaaucaaauggugaaaugagagcacaaagaccauguccua

SEQ ID NO: 4198814 - RNA, 129 nt, Human
uagagacagguaggaggccauuggauacauggugcaggaguguaggccuauguaggucauccaugcaugccuggcucugggaucuucgcuuuagucauuuaaaucaugggccugcugucuuuucuuaug

SEQ ID NO: 4198815 - RNA, 83 nt, Human
uagagacauauagaacaguugguuaacacaaauauucugcaaucacaauauaugugguauugaccagcuuuucaaaguuucua

SEQ ID NO: 4198816 - RNA, 78 nt, Human
uagagaccagauucugauucugauuaacugggaguacgaugauacagcuaaucagaaauugagggucugguuacuuug

SEQ ID NO: 4198817 - RNA, 59 nt, Human
uagagacugugccagccccaugcugaacuauagcagugaaugggcagacacggucccug

SEQ ID NO: 4198818 - RNA, 82 nt, Human
uagagagcuggaaccaauuuaugcuccuucugacauucacagggaaugcuccguauaaaucuuggucucuucuuccuuuuua

SEQ ID NO: 4198819 - RNA, 60 nt, Human
uagagagucgggaacuuaccugaggccacaaagcaaacccagggccaauccugaccucua

SEQ ID NO: 4198820 - RNA, 97 nt, Human
uagagaguucagggaaagugucucagucuguuugggcuauuauaacccauaaaccauguggcuuacaaacaacagacauuuauuuuuaacuguucug

SEQ ID NO: 4198821 - RNA, 58 nt, Human
uagagauacagaugggcgaggccagcagcuuuugggcuuuucuccagcugugauuuua

SEQ ID NO: 4198822 - RNA, 75 nt, Human
uagagaugcugauuauuucuugcuagcucugugagagcaauuucaacaacuaucaagagguagcagugacugcua

SEQ ID NO: 4198823 - RNA, 84 nt, Human
uagagaugggaaagaauagagacuuuaucacucauguaaagcagugucgauguagguuucugauucuugcuaguauuauuucua

SEQ ID NO: 4198824 - RNA, 79 nt, Human
uagagauuuggcucugggauaucuuugucagcuuuuugaguuuuccagguaaaagguuuucuaggguugagggucuuug

SEQ ID NO: 4198825 - RNA, 60 nt, Human
uaccagccugacccugucugaccugggcuaggaaggaacagacauggguccagguuggug

SEQ ID NO: 4198826 - RNA, 79 nt, Human
uaccagcuagcuagguccugagcauccauucaaucgcuagugaugaagaguggcuguaucagucaacccuugcugugua

SEQ ID NO: 4198827 - RNA, 60 nt, Human
uaccagcuguuaggcuuggugcuguaaugcagaggcaguacugagagaggcuguugugua

SEQ ID NO: 4198828 - RNA, 71 nt, Human
uaccagcuuuugaugcuagaaaaccccaggugggaaauggcccucugaguagacuggacaugaagcuggug

SEQ ID NO: 4198829 - RNA, 71 nt, Human
uaccaggacauagcagugguuugguguccugcccauuuguguggcaggaaauucuuuuguuugugcuggug

SEQ ID NO: 4198830 - RNA, 81 nt, Human
uaccaggacucuguaaaacaauauuguauucucaaaagcaauaaaaauuauaagggguugcaaguuauuuauagccuggug

SEQ ID NO: 4198831 - RNA, 57 nt, Human
uaccaggauggaaacuugacuuuuagaaaaucauaagagcuauacauucaccuggua

SEQ ID NO: 4198832 - RNA, 71 nt, Human
uaccagggggaaauugcucuuaaagagaagcugcaaaaugucuauaggaaaacgugauuuucucacuggua

SEQ ID NO: 4198833 - RNA, 90 nt, Human
uaccagguaggaaggagaccacagcugugaugggaacauguugacucugucucaggauggagucuauccagugucccaaauuacuuggua

SEQ ID NO: 4198834 - RNA, 57 nt, Human
uaccagugucuugguggauuugaguaagggaccgucuacuaugcuaaggcauuggua

SEQ ID NO: 4198835 - RNA, 75 nt, Human
uaccauaaaaacuauaguuugcaaaagagcacuguauuuccagauguuuugugcacuucuauagcaguuuuggug

SEQ ID NO: 4198836 - RNA, 66 nt, Human
uaccauccaaacucucauuaucuguaccgaaaagauauggacacauguuuugaguuagggcuggua

SEQ ID NO: 4198837 - RNA, 80 nt, Human
uaccaucuaaccaaguucuggacaggggaauaugagcagaagucauguaaucaaauuccaggcuguguucuuagauggua

SEQ ID NO: 4198838 - RNA, 129 nt, Human
uaccaugaugaagggaggagcuugcaccagcagguguaaggagugugaguuugaguucugcucaucagacagccuaagcagucacauccuugaauccuggucuuuugcaggccaguccuuggucaggug

SEQ ID NO: 4198839 - RNA, 62 nt, Human
uaccauuuacuugaaaauaaaaugucuguguuuccuggcagacuauuuaaaguagaugagua

SEQ ID NO: 4198840 - RNA, 67 nt, Human
uacccaacucagacuggauuaaauaaaaggggauuuucuugcuuauuuaacucuagauucaguggua

SEQ ID NO: 4198841 - RNA, 60 nt, Human
uacccaggagaaacagcagggcaauaacaaaaauggccuuucucuuacuucuguugggua

SEQ ID NO: 4198842 - RNA, 67 nt, Human
uacccaguugaugaguauuuuauuuuagcagcccaaauggacuaagaugacuacuuaccacugagug

SEQ ID NO: 4198843 - RNA, 78 nt, Human
uaccccgcagggcgccugcuguggccaccgagguguugccuggagcggggcugacagcaggugugcuccuguggagug

SEQ ID NO: 4198844 - RNA, 99 nt, Human
uacccuacaaagguuucaccuuuggccacuucauagaucauuggcuaauguugagucaguugucuauccgugguucaauugguuauaaccggaggggua

SEQ ID NO: 4198845 - RNA, 60 nt, Human
uacccuuagcuggagugguggaaugacuuaucuagucuucuguuacuguuagcugaagua

SEQ ID NO: 4198846 - RNA, 69 nt, Human
uaccgggccaagacagaagugauuugaugugauccauauucacguuugcauagcugauguugucuggug

SEQ ID NO: 4198847 - RNA, 73 nt, Human
uaccguagugucagggagugauaaaugcuaugaagaaagaugaaguaauuucucaaaucucugagacuuggua

SEQ ID NO: 4198848 - RNA, 103 nt, Human
uaccuaggaaugcuuagccaugggucccuagaagccugguuuuucaaacauacaagugcuuaaaacagcacugagccgccauucagaggacagcauccaggug

SEQ ID NO: 4198849 - RNA, 72 nt, Human
uaccuaucugcuggauuuguuguuagggcugaaugaacuaaaaugcccucacacgguggccagcaguaggug

SEQ ID NO: 4198850 - RNA, 86 nt, Human
uaccuaugagagcacacagaaauauuuuagcugguauaugcaugauuuaaguaaaagaauguuaaauguguuugcucuucuaugug

SEQ ID NO: 4198851 - RNA, 72 nt, Human
uaccucaaagacaggcuggggcugcagccaagucaggcaaugagcuggcugggugccagucucccuggggug

SEQ ID NO: 4198852 - RNA, 59 nt, Human
uagaaagacuguccagauuucauuucuugaugaaacgaugcuuuggguaagucuuuuua

SEQ ID NO: 4198853 - RNA, 56 nt, Human
uagaaagcaguaucuccauuuuuugcuaauauagggcugaaaaauacugcuuucua

SEQ ID NO: 4198854 - RNA, 64 nt, Human
uagaacacauguauuuaaauguggcuuauuuuauuagcaguuacucuuagauacuagugugcua

SEQ ID NO: 4198855 - RNA, 59 nt, Human
uagaacuaaagaacaacuuugaaaaugugugauauuucaaaguguucagaccaguucug

SEQ ID NO: 4198856 - RNA, 106 nt, Human
uagaacugagagacaagucaaauuaggaacgcucaggaaaaccacuuuuacugucucuuggaagguccugggcgauuuucugaauaugaaucuguuaccaguuuua

SEQ ID NO: 4198857 - RNA, 58 nt, Human
uagaacugcucucauacuugcuguauguuguggaucagcaaguauagucagccuucua

SEQ ID NO: 4198858 - RNA, 105 nt, Human
uagaagaaguugacaguguugucggagcaggccagcuuccugacauccugauggagacaauaggaaugagagaguaggcuuuuccuacaauaugucaaccuugua

SEQ ID NO: 4198859 - RNA, 62 nt, Human
uagaagagacaagacuacauuuauauacuuaucaguguuuuauguaggguuugccuucucua

SEQ ID NO: 4198860 - RNA, 76 nt, Human
uagaagauucuaaaguggagaguagaagacgugaaaguaagacggauguucucuacauuuuugcuuuagagcucua

SEQ ID NO: 4198861 - RNA, 85 nt, Human
uagaagcggcacaggacauggaaguauggaguggacagguuaccauuuguacgcggugauuguauuuuuaaaugugcuguaacua

SEQ ID NO: 4198862 - RNA, 81 nt, Human
uagaaggagagaaacaagguguagguugaccaaacauuugccuggguguguuaucuuccuuguucucaaaugauccucaua

SEQ ID NO: 4198863 - RNA, 67 nt, Human
uagaaggcaggugguuggaguucuguugaaggucccaucuaugaauuccaggcuccugcaguuucua

SEQ ID NO: 4198864 - RNA, 60 nt, Human
uagaaggguuagagcaacucagucaaauuccaggugagcagcuuacauguggccuaucua

SEQ ID NO: 4198865 - RNA, 64 nt, Human
uagaaguuggacuuguugguacagucaugccucugaagggggcauuuggucaaggacaacucug

SEQ ID NO: 4198866 - RNA, 67 nt, Human
uagaaguuuuuggccuggauuuuaaucaacacaaccauuguuuucaagucaaggccaaauucuugug

SEQ ID NO: 4198867 - RNA, 64 nt, Human
uagaauacaguuuaagaacuacugcucugccaaaccagauuguugaguuuccugacuguaucug

SEQ ID NO: 4198868 - RNA, 76 nt, Human
uagaauaguguugaccacuuagaggggccacuuaaguauuugcugaaugaguggauucugaguagaaccuagccua

SEQ ID NO: 4198869 - RNA, 61 nt, Human
uagaaucaaagauguuucaggguguaucccacagggacaugcaucuuuagucuuaugucug

SEQ ID NO: 4198870 - RNA, 60 nt, Human
uagaaucauugagaauaacaggcuuguaugugucuggugauauuuucagugaucauucug

SEQ ID NO: 4198871 - RNA, 107 nt, Human
uagaauguugcagaggauuucuugcguguagcugaucugagauuuuccaaguuccaagaaggggucaagcggcagcuacaggacauuuuccaaaaugcaacaaccua

SEQ ID NO: 4198872 - RNA, 59 nt, Human
uagaauguuuuacagaucccauuaggcucuaaugauuaguggguuacauagaacaucua

SEQ ID NO: 4198873 - RNA, 96 nt, Human
uagacaaauccugaggaaggacuccaguuggccccaguugguucaugggcccaucccuguuuuaaucacuguggccagguggugugggguauucug

SEQ ID NO: 4198874 - RNA, 104 nt, Human
uagacagaagauggauugauagauuggaccuggagauguaaauaggauaguuuauuuaagcugcuuagagucucuucuuaucuauccaucuauuuaucuaucug

SEQ ID NO: 4198875 - RNA, 80 nt, Human
uagacagcacuagcuuuaagcauucugcuacuaaaauaucuauaguaucagaaggugucuagcuguguguuaccugucug

SEQ ID NO: 4198876 - RNA, 80 nt, Human
uagacagcacuguuccagaucaggacaccgucugggucuuaacugauagaacgccuugaucuuggagcgugcuccuucug

SEQ ID NO: 4198877 - RNA, 113 nt, Human
uagacagggcuccagcucccagcccagcgcucaggccucugcaucacacugguccccaggagaggagaugcuggccuggccaucuggggauggaagcaggagccucacgucug

SEQ ID NO: 4198878 - RNA, 57 nt, Human
uagacaugguuguacguuaucucacuacaucucgguacaugucuacagccaugucug

SEQ ID NO: 4198879 - RNA, 62 nt, Human
uagacauuuggaguuuuaugaccuaagaggaaagaaccuuuggaaugaaauuuuugugucug

SEQ ID NO: 4198880 - RNA, 73 nt, Human
uagacccaauuuccuggagcaggcaccagagugauccuggugcagccucucugcuucaggaacuugccaucua

SEQ ID NO: 4198881 - RNA, 84 nt, Human
uagaccguauaggguaacuuccuuggguugccauggcauuuauaaacugucauggugcuggugggaguguauuuuaaccggcua

SEQ ID NO: 4198882 - RNA, 68 nt, Human
uagaccugccuugauuguccugcuucugaugggauagacaaaagaaaucaggaacaguaaggagccua

SEQ ID NO: 4198883 - RNA, 73 nt, Human
uagacuaagguuacagagcuagucagugucagagcccggcuucaaacucaggacugccugucuccauagucua

SEQ ID NO: 4198884 - RNA, 87 nt, Human
uaaaacaaugccucuuggaagaagacuuaguucaagacaacaguagccacaacuuaucagaguuuauugucuuccaggcuuguuuua

SEQ ID NO: 4198885 - RNA, 81 nt, Human
uaaaacauuaguuacagaauguacagagguuuaugguuuauuucccagauagcuuguguuuuucuaaguaucugauuuuua

SEQ ID NO: 4198886 - RNA, 67 nt, Human
uaaaacucuaaauuacacaguguugugccaugaguuugguauuguaacaacaauaguuuagguuuua

SEQ ID NO: 4198887 - RNA, 78 nt, Human
uaaaacucuucagaacagcacagggugauuuggguauagcuaucuccagauaccuuggcccuuguucuuggaguuuua

SEQ ID NO: 4198888 - RNA, 72 nt, Human
uaaaagaauuuuaucuuauuacuugcaaggcaguagaaucugagugcuaaguagugauguagagauguuuua

SEQ ID NO: 4198889 - RNA, 56 nt, Human
uaaaagagaauggauaacagaguaacuuucugacuguguuauucagucucauuuua

SEQ ID NO: 4198890 - RNA, 55 nt, Human
uaaaagaugaugucuuggcccaagcaaugcaggguccagguuuagucauuuguua

SEQ ID NO: 4198891 - RNA, 69 nt, Human
uaaaagcucagugaguuuagucacuuuuuaucuuucccuuuaaaucugaaugauuguacugagcuuuua

SEQ ID NO: 4198892 - RNA, 73 nt, Human
uaaaaggccaguucugggccucaugcacagagaugcuaauuuaguaugucuagacccaagaauaugccuuuua

SEQ ID NO: 4198893 - RNA, 70 nt, Human
uaaaaggcugagagucacaguccuaauggucucaucuucugcccuaugacugucagaucuaggcccuuug

SEQ ID NO: 4198894 - RNA, 78 nt, Human
uaaaagucacaaauccugcagcuggagaggcgaugugagaaccugacuuuguacaggugcaggcauuugugagguuug

SEQ ID NO: 4198895 - RNA, 117 nt, Human
uaaaauaauaauaucuauuuuuuucaauauuaugaagauugugcuuggccuguaauaggugcucaaugauugguggcuauuaguacaauuauuuuuauuauugucauuauuguuuua

SEQ ID NO: 4198896 - RNA, 95 nt, Human
uaaaaugaauaugacauauuucuuucaagggcaugaauuauauucgguagacaaguuuccacauucaguuuuugaagggaaauucguucauuuua

SEQ ID NO: 4198897 - RNA, 119 nt, Human
uaaaaugagauaaagaaugaaauauguuugauaucauuauacagacguauacauaacucuguguguguguguguguguguguguguguguguguguauacucuuuuuuguuuuauuuua

SEQ ID NO: 4198898 - RNA, 130 nt, Human
uaaaaugaggccagaagaugggagauguaacaaguggcuuuggcccagacucggggacugaccuuggaggauccauccucagcucugaucuggauccucaagcuuuguuucuccuacuggcagccccagg

SEQ ID NO: 4198899 - RNA, 81 nt, Human
uaaaaugggcaugauaguggcauuuauggcacagcacuguggugcugcucaaugagaugccaucugacguauaacauuuug

SEQ ID NO: 4198900 - RNA, 80 nt, Human
uaaaauguagauucucggcccaugcucccugaaagugcugacacaguaagucugggcugggcuuaggaacccuuauuuua

SEQ ID NO: 4198901 - RNA, 75 nt, Human
uaaaauuuguucaacaggugaaauagaagauggugaaaaugucaaucuguuuugaaucuguugaauuuuguuuug

SEQ ID NO: 4198902 - RNA, 108 nt, Human
uaaacagaugacaaauggaaaauaguucaucacaaugaucaucggggaaagcauuuugaguagcuuaucauuugaacagaauuuguuuuucuaaccuguuucuguuug

SEQ ID NO: 4198903 - RNA, 61 nt, Human
uaaacagcuauuugaggacuggcuugaauauuuuuaaccaguuuaagcaaauaacugucua

SEQ ID NO: 4198904 - RNA, 71 nt, Human
uaaacagucgucuuaauaguauucagcuccaagaaagaaaagaugcaaggaauacgcugagaugaaguuug

SEQ ID NO: 4198905 - RNA, 84 nt, Human
uaaacagugguuaauaugcugcuucuugaaaagacauauuacaacuuacagucuuucuucauaaguguauguuguuacuguuua

SEQ ID NO: 4198906 - RNA, 83 nt, Human
uaaacaugccuugguuuuacuguauauauguauguguguauguauuuuuuauauaugacagaauguguguguauguguguuua

SEQ ID NO: 4198907 - RNA, 82 nt, Human
uaaacauggaacugcccagggccccauuccagaccaaccgaguuagaaucuccagggguggggcccaggcaucugauguuua

SEQ ID NO: 4198908 - RNA, 56 nt, Human
uaaacauuucaugcagaaggaaguuggggcaaaggcuccagaacuucaugaguuua

SEQ ID NO: 4198909 - RNA, 56 nt, Human
uaaaccucugugcuaugacacccucaguaccugggcuaggggugggcagagguuug

SEQ ID NO: 4198910 - RNA, 68 nt, Human
uaaacgaugauaaauuguucucugcuucacuaucaacauccaaguagcagaacaauagucaaugauua

SEQ ID NO: 4198911 - RNA, 57 nt, Human
uaaacguucgugcaacuaagcugagguuuuuuucagcugagaauaaggagccguuug

SEQ ID NO: 4198912 - RNA, 84 nt, Human
uaaacuaauuuuacugugcuuuacuguguugccuuuauuguuaaugaaugguaaagaaaagcacuguauuuaaaauuggcuuua

SEQ ID NO: 4198913 - RNA, 79 nt, Human
uaaacucuuccugaacuuuucugugaugcugacaguccgaugugguggggcugcagcuaugggaaauaggauggguuug

SEQ ID NO: 4198914 - RNA, 78 nt, Human
uaaacuggaauccuuaggaaagcauuguguaaaagcauggaugcauauauuuuuuguuauucuaugauaagcaguuua

SEQ ID NO: 4198915 - RNA, 79 nt, Human
uaaacuuuguaacucugaauacauccuacuugcaagucucuauguaauguaguauccggaguuugauagaauugguuug

SEQ ID NO: 4198916 - RNA, 128 nt, Human
uaaagaacaaaggaaaaccugaauaaaaggacaauggccuucaggcuuagugauaagaaaaauuaacagugaccugaaugucaauuuuuuggccuauuuguucuuugagguuuuuauuuuuuucuuug

SEQ ID NO: 4198917 - RNA, 63 nt, Human
uaaagaaucagguguuauuuuuugguugcacucucaaagccuagcacaguuccugacucuuug

SEQ ID NO: 4198918 - RNA, 97 nt, Human
uaaagaggcaguuaggaaucagagagagcaggaaaccuccggcaaggcugguucauuagugccucugcugauuaaucaagaccuggcugccacuuug

SEQ ID NO: 4198919 - RNA, 80 nt, Human
uaaagaucuccagauguaagaccuucaugagggcuuuuagaagaaagucccaguccccgucucuaugucugaguuccuug

SEQ ID NO: 4198920 - RNA, 55 nt, Human
uaaagcauguguuagaagugcagacauggguauucucuagcaaagaaaugcuuug

SEQ ID NO: 4198921 - RNA, 127 nt, Human
uaaagcuucgcuggugaaucuagaccauguuuugagccauuguuuuaauaaaagcacuagugcuuccuucaucuaaagcagugguucucaaacuugccuguucuucagaaucacuuggaaagcuuua

SEQ ID NO: 4198922 - RNA, 56 nt, Human
uaaaggagugggaacaaugacauggucaaagugagaccauucuuccuacucuucua

SEQ ID NO: 4198923 - RNA, 63 nt, Human
uaaaggcacaaaauccaaguagcaagcaugaaaugugguuugcauauuaaaucggugccuuua

SEQ ID NO: 4198924 - RNA, 57 nt, Human
uaaaggcacugcgucccucaaauucagaguuagagggugacauguaguugaucuuua

SEQ ID NO: 4198925 - RNA, 86 nt, Human
uaagcaauucuggauuguugaaggcuggcaauauauuuguuacaacauguaaugagugcaaaaguuacaaaccaaggauugucuua

SEQ ID NO: 4198926 - RNA, 111 nt, Human
uaagcauguuuucaagguccagcuauguuauagcauguaucaguauuucauuucuucuuauagcugaauaauauucuaugauauggauauaccauauugggcauuugcuug

SEQ ID NO: 4198927 - RNA, 75 nt, Human
uaagccaaaauaucacaguggcuaccucuggaugcagauuaaaaucuggaaauccacuugccacuguauaguuua

SEQ ID NO: 4198928 - RNA, 75 nt, Human
uaagccaauguacaaaauaauuacacaucugcuucuauaguaugcacagauguugcuguuguugucauugauuug

SEQ ID NO: 4198929 - RNA, 85 nt, Human
uaagccagucugaaauucagcauacauugcacccugguaguaucacuuugguuguauucccacaaugugugcuucaucuuacuua

SEQ ID NO: 4198930 - RNA, 124 nt, Human
uaagccccuuuuuauauggcagaggcaauuucauuuaaugauggcaaugauggauaguuacacauucacaauggauugcuucaauaccugcucauaauccuacaauauuaaaaagaaucccuua

SEQ ID NO: 4198931 - RNA, 65 nt, Human
uaagcggccacacaaacacagccaguuuccauuuagaagcagcugcaugucugugguggucuuua

SEQ ID NO: 4198932 - RNA, 65 nt, Human
uaagcuaacguccauggaaaugcaaaagacuguaccagcccauugcuuccuggaccuucaguuua

SEQ ID NO: 4198933 - RNA, 70 nt, Human
uaagcuuucagcagcagccuccugugcuacagcucacacagucaggcuguggcaggcagcuggaagcuug

SEQ ID NO: 4198934 - RNA, 82 nt, Human
uaagcuuuguuucuucaggcuuuuaggaggaacacuuaccuuaauccucuuaggucucugggccuugaagugauagcgcuug

SEQ ID NO: 4198935 - RNA, 104 nt, Human
uaaggaacuuggguaaaauguuccuaaugugcuuuucauagauaaaauucuauuauucaauaggaaguacugaaaggcguacuuaggauugcuuauuucucuua

SEQ ID NO: 4198936 - RNA, 56 nt, Human
uaaggaaggggaaagacaugucuuugacuaggaugauauguguuucaccauccuug

SEQ ID NO: 4198937 - RNA, 61 nt, Human
uaaggacaauuugucgcuugcagccacugccuuaucacuguaaguuggaagguuguuuuua

SEQ ID NO: 4198938 - RNA, 79 nt, Human
uaaggacucacucauugauuuauagaauguucaagccuccugguuuuaacuggacugaaguuuaucugaguaauucuua

SEQ ID NO: 4198939 - RNA, 63 nt, Human
uaaggaggcugcugugaagaaaggacaugcaauuccuccugccaucacacuguggcuucuuua

SEQ ID NO: 4198940 - RNA, 55 nt, Human
uaaggagggagagaggggaaugaacacccauaucucacucucuuuccacucuuug

SEQ ID NO: 4198941 - RNA, 93 nt, Human
uagacuauuuugauuggugugcuuuauucuuaccuauuucgguuuacaaaaauaugcaaauagguguaaugacaaccuucagaauguauucua

SEQ ID NO: 4198942 - RNA, 65 nt, Human
uagacucauagaauuggauagugcaagauaagucaaagacagaccgcuucccaauucuugaucug

SEQ ID NO: 4198943 - RNA, 59 nt, Human
uagacucugcauuuaccucccagguaauuuugaccaugggacaggagucagaggaucua

SEQ ID NO: 4198944 - RNA, 69 nt, Human
uagacugauuaaaaacagacauuuauuuucucacaguucuggaggcuggaagucugugaucacgugcua

SEQ ID NO: 4198945 - RNA, 81 nt, Human
uagacuguggaccucagagcuuggguuuucuuaauggaggaauuaucagggagaaaacuggagccugggguugcuaagcua

SEQ ID NO: 4198946 - RNA, 66 nt, Human
uagacuuaguacaacucacuugauuuuagccaaaaggcugagaagcaaugacuuaguacaacucua

SEQ ID NO: 4198947 - RNA, 117 nt, Human
uagacuuggccuuuaaaauguuuuuuaaauugaaugauuaaguggugaugaaccagaaaaaauaccuugaaauugaucccauuuauuaauuaguuugcacauguaaaggucuuucua

SEQ ID NO: 4198948 - RNA, 103 nt, Human
uagacuuuagacacugugccuugcauggaucaggagaugagaccauuaaauauugauuuccuaauuuaugcaggaguuuuucauacucuaaaaaaucaguuug

SEQ ID NO: 4198949 - RNA, 72 nt, Human
uagacuuuuagcauuguacauuugugcuucuauaggucacucauugaagcacauuguacauuugugcuucua

SEQ ID NO: 4198950 - RNA, 63 nt, Human
uagagacaucccaagaugacacaguggacgaccaaaugcucaccacuguuuucuggggcucua

SEQ ID NO: 4198951 - RNA, 85 nt, Human
uagagacugcuggugcacaguaccugcucucaagcaaacgccucucuuggcuuuacugagcauguacuaugugccaggggcuuua

SEQ ID NO: 4198952 - RNA, 69 nt, Human
uagagagacaccuacacacauacauauacacauguauuauguguauguauauaggugugugucucucua

SEQ ID NO: 4198953 - RNA, 64 nt, Human
uagagagauguaugcauuugucacaaaucagcuccugcauguguuagauuugugcauuucacug

SEQ ID NO: 4198954 - RNA, 97 nt, Human
uagagauugucuguucaccggggaaaggggcccagugacugacgauggaccagcuggaaugcagucagcuuggcuccucccaugaaccacagcucug

SEQ ID NO: 4198955 - RNA, 84 nt, Human
uagagcauaacgugucuguaaggaguccucaugucugugcgagcugggcuguguucuaggcugaggaguuugcgauguguucua

SEQ ID NO: 4198956 - RNA, 98 nt, Human
uagagcccccuggcugggugggucugggcaggcgcuuccucccggagcuggcugggcaccgcucccagacccaggcuuuucuaggucaggcaguucua

SEQ ID NO: 4198957 - RNA, 76 nt, Human
uagagcugaauguuuuucauuggugacucuucuuaccuaguguugucucugaaaaagauucagaauccuggcucua

SEQ ID NO: 4198958 - RNA, 80 nt, Human
uagaggagucuugaaaccagcgaggugaguccuccagcucuguucuucuucacggucaucuugcuguuuuagaucuucug

SEQ ID NO: 4198959 - RNA, 81 nt, Human
uagaggauauagagacaugcaguuguugugaauuacauaaccauuuccaaaaauucuaauaaagugauucuacuuccucua

SEQ ID NO: 4198960 - RNA, 97 nt, Human
uagaggauuaugauuuauucucaucaggaauuauccuaauuauuauggauuuuggcaguuugagguuuucugauguagaauaacaucaugucuuuua

SEQ ID NO: 4198961 - RNA, 56 nt, Human
uagaggcgggucuuuggaggugaugcggagggacggccccaggggacccagcccua

SEQ ID NO: 4198962 - RNA, 63 nt, Human
uagaggcuuacuuguaccgcaacgugacuguuauauuucuuuuguugcugaaggaagccucug

SEQ ID NO: 4198963 - RNA, 67 nt, Human
uagaggcuucaguuguaccuucuugcugugauacaaauugucugaauguaucgaauugaggcugcug

SEQ ID NO: 4198964 - RNA, 81 nt, Human
uagagggcagcccagagguuccaggcuagggaggaacucuuucugagcuuuggaaguuucaccagggccacaugcauuuua

SEQ ID NO: 4198965 - RNA, 73 nt, Human
uagaggggagcugcagaaggcacucacacuggcacggcucccaaugcuaguagcagugucuugcuccgcccug

SEQ ID NO: 4198966 - RNA, 68 nt, Human
uagagguaguaacauuuugccaucuggcaaagccacuagaccagauggauucauuaaugacuucucua

SEQ ID NO: 4198967 - RNA, 96 nt, Human
uagagguguauuucaggaaggauggcgagguggagagggagcuuuugucacucugucuaucccauucugugcauucuuggaauguuacauuuucug

SEQ ID NO: 4198968 - RNA, 103 nt, Human
uagagguuguauauaagauagauuagaguugacagugagugccaaaagauauaaauggcuuauaguggcaguucaggcugcaaucaugaugcuacaaucucua

SEQ ID NO: 4198969 - RNA, 68 nt, Human
uagaguaugcuagaagggagcacuauguuagaagggagcagaguuguuucugaauagcucauuuucug

SEQ ID NO: 4198970 - RNA, 64 nt, Human
uagagucagaaaguagugugccuauuuaaacacaaguuuucugggucuagugcuuuucacucua

SEQ ID NO: 4198971 - RNA, 55 nt, Human
uagaguguuguaauugaaaaggaugauuuucuggugguugaauuucagcacucug

SEQ ID NO: 4198972 - RNA, 75 nt, Human
uagaguuaaaccuggguuggagcccugcuucagucauuuacuagcaguguggccuuagacccggccucagcuuug

SEQ ID NO: 4198973 - RNA, 91 nt, Human
uagauaaagucuggauaguuugaguucaugaugacagugaaauuuuaauauaauuuauaucauugcaagcucauuuaucugcuugacucug

SEQ ID NO: 4198974 - RNA, 55 nt, Human
uagauaacagcacuggccucgcucaccaaagagaggagcuguguguuguuuucug

SEQ ID NO: 4198975 - RNA, 83 nt, Human
uagauaacugguaaauagugaaagaagagugaggagucaacagaugauucugcuucuuauuucacgugcuuuagugguauuua

SEQ ID NO: 4198976 - RNA, 68 nt, Human
uagauaacuugcaccuacaggauguaccaagagccucucacauuacucuguaaguguugguuauucua

SEQ ID NO: 4198977 - RNA, 114 nt, Human
uagauaauugauugguucauccucuucccucuggcugguguugcauuuugguuguaaauaugcacgaagugugugcaugugaaugugggacuggagggaaaccaugaguaucua

SEQ ID NO: 4198978 - RNA, 58 nt, Human
uagauacaggcaagauuaugaaccaaaauuaauguuauuaauauuuugcuuguauuua

SEQ ID NO: 4198979 - RNA, 69 nt, Human
uagauacuuacuuuucuucagacuacaaucuagaauuuguugguagaaagacaaagugcacagugucug

SEQ ID NO: 4198980 - RNA, 105 nt, Human
uagauauggcuaaggaagucucuagacagaauauuguaagugccacuuagcuucuucuaacuguguaugauauguacugggagagaugagcuuuaggcagagcua

SEQ ID NO: 4198981 - RNA, 70 nt, Human
uagaucaggcugcuuagauagaaucaaauauuguuuaacauuuugcaaguuaucuagcuagucugagaua

SEQ ID NO: 4198982 - RNA, 56 nt, Human
uagaucauauuuguggagaaaacuaaaagacguuuuagcuaauagaugcuggucua

SEQ ID NO: 4198983 - RNA, 75 nt, Human
uagaucaucuuucuuauuuucugagaauuugauacaguugucaggagcucagcuaaguuggagagagcugaacug

SEQ ID NO: 4198984 - RNA, 55 nt, Human
uagaucauggguacugcauaugauggaagaaauuucuuaauguucccauguucua

SEQ ID NO: 4198985 - RNA, 57 nt, Human
uagaucuaaugcaguuuauguaaacguaaguuacugugguuacugcuauuagauuua

SEQ ID NO: 4198986 - RNA, 76 nt, Human
uagaucuagucucucuggguccuggcaagcucacagauagaugugggccuauauauggcugagagagccugauuua

SEQ ID NO: 4198987 - RNA, 58 nt, Human
uagaugaaauuuguguguaugcaugugugugugcgugcauauguauaugauuucucug

SEQ ID NO: 4198988 - RNA, 63 nt, Human
uagaugagugggagcugcuaccuccuuccaugcccaugggcagggguagcauuccaaguacug

SEQ ID NO: 4198989 - RNA, 71 nt, Human
uagaugauaccucagcugggcuuuaggagcuacagaagaagcugcaucuccaugagcucagcguguuucua

SEQ ID NO: 4198990 - RNA, 70 nt, Human
uagaugcuuguucagaaauagguacaucuguguuuacuguagugaacacauauuucugggcaaccauuua

SEQ ID NO: 4198991 - RNA, 61 nt, Human
uagauggggaggagguuauagcugcuuucacaguaagaucuauuaauuuuucuucccacua

SEQ ID NO: 4198992 - RNA, 79 nt, Human
uagaugugagaauucuuaguacauagaugaugguugaauuucagaaaaugaaaaguuagccuguguguauuaacaucua

SEQ ID NO: 4198993 - RNA, 61 nt, Human
uagauugagcuugacaguguuguccuaaagauucuaagggaaaauucuguaguuuaauuug

SEQ ID NO: 4198994 - RNA, 83 nt, Human
uagauuguuacuucguuucuucacaagcauagacuucuuugucugcugcuucuguugaagcacauaaauccaaguggcagcug

SEQ ID NO: 4198995 - RNA, 72 nt, Human
uagauuuaaggaaaguuuauagguuauauaauuggauccaaauauuauauuauguggauguuccuaaauuug

SEQ ID NO: 4198996 - RNA, 90 nt, Human
uagauuuaauuugagagcaaauguuugcuuaaggaggaaguuacaggaaaguuuucggaagucagauaggugaguccaaauuaaagucug

SEQ ID NO: 4198997 - RNA, 66 nt, Human
uagauuucagccccgcucccagcugucugagucacaucccgcaccucggggcaggcauggacccug

SEQ ID NO: 4198998 - RNA, 130 nt, Human
uagauuucuagucccuuagucucuuugugggucaauguaacugugcuuaugccugauguuaaucacauuccuuucuugagcacaguuacacauuuuguugauagcaaggagaagaggaaugagggaauga

SEQ ID NO: 4198999 - RNA, 98 nt, Human
guguguguguguguguguguuaugacagaucuuguacucauuauugaauaauucauuguugcguuaaugucuucagauaccaucucucacuuccucac

SEQ ID NO: 4199000 - RNA, 85 nt, Human
guguguuaccaccuuuaauuuacaauguuaauuggguuauuaauuuccuaaaucuacuuuuguagauaaagaugugcuaacauac

SEQ ID NO: 4199001 - RNA, 102 nt, Human
guguguucuuugugguuggggccaaaauuugaauaagccuugccaaaucacuuuaaaguuuagcuugaaucuuguuuaaauuccuuaucacucagauuuaac

SEQ ID NO: 4199002 - RNA, 81 nt, Human
guguguugagugaauaagaccuaaggaugaaucaucaucugugauaucaucaaaaggguauuauuggagcugcagcaacac

SEQ ID NO: 4199003 - RNA, 72 nt, Human
guguguugguuugucagccucuugcuuaucaccuucuggucacaagauggcugcugcagcccccaacaucac

SEQ ID NO: 4199004 - RNA, 62 nt, Human
guguguuguuuaagcugcuguuuguggucauuuguuagagcagcaauaauaaaguaauacac

SEQ ID NO: 4199005 - RNA, 82 nt, Human
guguguuuggacgacggauucuggguggacuuuuggaccaacuaaaagacccucuagagucccagugaucugcagagcacac

SEQ ID NO: 4199006 - RNA, 60 nt, Human
guguuaacugagaaauacccaagucugguaguucuaccaaucugguauauuccagaauac

SEQ ID NO: 4199007 - RNA, 80 nt, Human
guguuaaggggaugccuaguggagucuccacgcuggacaaaaaggcuucugagauucuuaugggcauugucccauagcac

SEQ ID NO: 4199008 - RNA, 87 nt, Human
guguuacgucuuccuucucuuguccuuuuguucugucaugcuuagacuaggcagugagcuggagggaaggaacugacuaguuugcau

SEQ ID NO: 4199009 - RNA, 128 nt, Human
guguuaggacagucaauucuuuaucuaauguugaguaugaauugcuuugccuguaucuucccaugaacucuauagcaaaauaguuuccacacuuucagaggugaacuugaauuuacuuagccucccac

SEQ ID NO: 4199010 - RNA, 63 nt, Human
guguuagucugagacuuuuucugugugggagagauuguauccuacacacagucuagaagacau

SEQ ID NO: 4199011 - RNA, 75 nt, Human
guguuagugucaccagcuugucugcacugggcaugggacauggggugcaugcagauugggaaaguuaauuggcac

SEQ ID NO: 4199012 - RNA, 82 nt, Human
guguuauuucacaaaacggacugaagaucuugaauuuacugacaucauaaauacaauuucaggcuguaauuuugaauggcau

SEQ ID NO: 4199013 - RNA, 56 nt, Human
guguucagccagcaucagcuaagugccuagcauugugccagaugcuggcagaagau

SEQ ID NO: 4199014 - RNA, 72 nt, Human
guguucagcccuuuccaauuugauuuauuaaaaguuuccuuucauaauccaagaggggaagaguggaauuac

SEQ ID NO: 4199015 - RNA, 65 nt, Human
guguucagugguaucucauugugguuuugcuuuccauuuccaugauggcugaugauauugaacau

SEQ ID NO: 4199016 - RNA, 84 nt, Human
guguucaguuaauuugggaaaugcugagguaaaucagauuaaaaggcuuuuuacccuggguauuucccaaacuuuucugaucac

SEQ ID NO: 4199017 - RNA, 60 nt, Human
guguucauggaugucaauuugagauucugagauauucagucacucugacuugaugaauau

SEQ ID NO: 4199018 - RNA, 87 nt, Human
guguucauuaagaaaauaguuaugcucuagacaagaaugcuuccagauuucuuacuguuuaaguaugacuagcucaugauuuucuac

SEQ ID NO: 4199019 - RNA, 128 nt, Human
guguuccagccucuccugcgccuccagauacggcugcuuccugggucugggugucugaggggacgucccucaagguucccacccagcucagccugucaggagccgcacccugcgaggccugagaccac

SEQ ID NO: 4199020 - RNA, 72 nt, Human
guguucccaccuaggaguguuaggaaguuguguuuguguuucaagcagaaaaacugagcuccaagugagcac

SEQ ID NO: 4199021 - RNA, 83 nt, Human
guguucccauucugaguuuuucaaaucugaauuugcuuuugucagcggcuuacagauaaugaggagacuccuguggcggaugc

SEQ ID NO: 4199022 - RNA, 78 nt, Human
guguuccuguaccaaaguugaguggaccagcccuguggcacaugccuggcaaggcugcccacuucaaaagagcagcac

SEQ ID NO: 4199023 - RNA, 79 nt, Human
guguucguguaugucugauaaaagugaccuuuagccacuuuuaugugguuuauguuuuucagacguccuacacagagac

SEQ ID NO: 4199024 - RNA, 80 nt, Human
guguucuauugauucagccaucuccaugcugagcacagaacuuugcccagaauagaugggcugugucaaucaaagcccac

SEQ ID NO: 4199025 - RNA, 58 nt, Human
guguucugcagaccagcaucaucaguaucaccugggagcuuguucaaaugcagaauac

SEQ ID NO: 4199026 - RNA, 89 nt, Human
guguucugugaagcgucuauuucuuugaaucuuuucguacagucaaaaugagaauguccagaggugagucagagcuucucaaaggacau

SEQ ID NO: 4199027 - RNA, 57 nt, Human
guguucugugcaucagaguugagcuggcuucgcuaucugcaucugagcacaaaacac

SEQ ID NO: 4199028 - RNA, 101 nt, Human
uaggaggauuagguuaaaacuuguuuuggaacagagugaauggagaaauguacaaucuauugauuuagcucaagacacauguuuuaaagaaauugggacug

SEQ ID NO: 4199029 - RNA, 56 nt, Human
uaggagguggaaguuguggagcaguguuucugcuguccauaagagaccaucuccua

SEQ ID NO: 4199030 - RNA, 67 nt, Human
uaggagguuugucuuuuuuguguugguucaaaagaguucuuuauauauuagggagauuagcccucua

SEQ ID NO: 4199031 - RNA, 78 nt, Human
uaggagucgcugcuuucuguuaggaauugggggcagggggaguuuccuuccaauuaacggaguggcggcgaccuuuua

SEQ ID NO: 4199032 - RNA, 55 nt, Human
uaggaguucuuucccaucgaggggaugcaacuuccuagcagggagaggauaccug

SEQ ID NO: 4199033 - RNA, 122 nt, Human
uaggaguuggguagcuaagagggcuuuguguuuugucucuggguuccuacugcuuugaaguuaaaauggaaauuuggcaagugggaaauuaguaaagugcucuaaaugcuuuuggcaucuug

SEQ ID NO: 4199034 - RNA, 80 nt, Human
uaggaucagggacuggccaggguuuggaauagauacacaugauauaauuauucuauugugaauucauucccuuuuuucua

SEQ ID NO: 4199035 - RNA, 81 nt, Human
uaggauuggguugccaagaagguggggacaugcagacaccaaaaugugcugcgucucucucugucucucuguauccuccua

SEQ ID NO: 4199036 - RNA, 69 nt, Human
uaggauuucaugaggcauuuugcauuuaaguagaucuuacuucuuugaaauguuucuugauuaauccua

SEQ ID NO: 4199037 - RNA, 65 nt, Human
uaggcaacaugucgaauacugucuuuauuuaaaaaaaauuaauugggcgugguggcaugugccug

SEQ ID NO: 4199038 - RNA, 59 nt, Human
uaggcaccaccuagggugacccagccccagccuagguggccccacccuggguaguccug

SEQ ID NO: 4199039 - RNA, 108 nt, Human
uaggcagacuucuugccccuccuuggggagacccugagguuuucuguacuagacagaguuuguuagugcagcugagccccauggcugcccacagcgguaaccugcuua

SEQ ID NO: 4199040 - RNA, 101 nt, Human
uaggcagugugaaauagcagacagaacaggcuguggaucaggagccuugggccccaacuuuccaacuucaccccagcuucaucccuaugucauccugaaug

SEQ ID NO: 4199041 - RNA, 57 nt, Human
uaggcaucacuccaucuuucuuccuuccugaggaccaaaaugugagcgugaugcuua

SEQ ID NO: 4199042 - RNA, 80 nt, Human
uaggccccagucucaguucacguugguaaagugagacccauucugccacguuucccugaggcucuuugcuugggcgccug

SEQ ID NO: 4199043 - RNA, 63 nt, Human
uaggccccuagugccacguggcaggcugugacgccagagccacacguggccaccaguggcuua

SEQ ID NO: 4199044 - RNA, 98 nt, Human
uaggcuggaaugaagccagaaggccuggggcacuauggggggcugaggcuggaguuagcccuccaggccccuggccuucugcgccugcguuuccccua

SEQ ID NO: 4199045 - RNA, 72 nt, Human
uaggcugggggauucgcuggugcugggacucucauccuacaacuuggauuccaguuaaugguucccagucug

SEQ ID NO: 4199046 - RNA, 73 nt, Human
uaggcuguauuuuagauauguuuuugcuaaugcagucaucacacugcaugguaacuauuuguuuaaaagucug

SEQ ID NO: 4199047 - RNA, 73 nt, Human
uagggaagggaaguagcaucugagcuucaaucuguacaugcacuaugaccuuugacgcuauuuaauuugccua

SEQ ID NO: 4199048 - RNA, 70 nt, Human
uagggaccaaaagguggggcagcuccaggcccaggcuguagucuuggcuccuguugucaucagcucccua

SEQ ID NO: 4199049 - RNA, 93 nt, Human
uagggagaagagaaauaugacaaaaaugcuaacuguguugaaucuagaugaugaacacauggguguuuauuguacuauaucuguuuuucucua

SEQ ID NO: 4199050 - RNA, 64 nt, Human
uagggaugacgaaaggacagagaacaccaccaguuuucuccaaaaaacccuuuucucaucucua

SEQ ID NO: 4199051 - RNA, 73 nt, Human
uagggauguggccuucggucuuuccucgcagcuccggggcaagcuaggagugggauggaagucgaggucccua

SEQ ID NO: 4199052 - RNA, 74 nt, Human
uagggcacuguaguuaggaaaacaucuuggccucugaguucaagacgauugccagguuccugagucaugccuua

SEQ ID NO: 4199053 - RNA, 81 nt, Human
uagggccacugaggggucauggugggagucaaggaaaucaauauccaaacuucucucccaccauucucccuuagucuccug

SEQ ID NO: 4199054 - RNA, 97 nt, Human
uagggccgcuguguuguauaauuccaggguucacugauuacguagaauauaacaugaauggcacccaguggagcugugcuccaacacaguggcccug

SEQ ID NO: 4199055 - RNA, 75 nt, Human
uagggccugggcaucuggauuuuuaaaacuccccagguugcuaauguguagccagagauugagaugcaggcccua

SEQ ID NO: 4199056 - RNA, 63 nt, Human
uagggcugauucacauuaggaagagaugaagugguuauaacuucacaaucaaaaucaguucug

SEQ ID NO: 4199057 - RNA, 59 nt, Human
uagggcugucagacugaggaggcccaaaagcuuuugagguuuccuccagauaagcccug

SEQ ID NO: 4199058 - RNA, 82 nt, Human
uaggggaauuugucguuggugaaaaaauguagcugaagauuuucaguuaacaaguuggcaaucaacuuuaagaaagccucua

SEQ ID NO: 4199059 - RNA, 93 nt, Human
uaggggagcagcaguggcugcaggucccaccugucugggucucaguguaagcccaccucccgugguggccuggggccucugccugagccucua

SEQ ID NO: 4199060 - RNA, 98 nt, Human
uaggggcgguauuuggggggcugaggagagcuuuuuuggucuacauuguggagcagaaauggccucuugucacagcccuuaguacucaagagccuuua

SEQ ID NO: 4199061 - RNA, 58 nt, Human
uaggggcugagggagaacagccagcaagaaauugaggcccuuagccuuauagccucua

SEQ ID NO: 4199062 - RNA, 63 nt, Human
uagggguggagcuaagagucccaaaucuaauccugccuuggucuuucugguaaccagccccua

SEQ ID NO: 4199063 - RNA, 79 nt, Human
uagggguggagcuaggauaagcagagacuggguuauaacccuuucagcccaaauauucuaucucucuaaguagccccug

SEQ ID NO: 4199064 - RNA, 92 nt, Human
uagggguugguaaacuauggcuucugggccaaauuuagcuugcugccuauuuuuauauggccuaugagcuaagaaugguuuucacauccuua

SEQ ID NO: 4199065 - RNA, 63 nt, Human
uagguaaacuucccuaugaggacucugcuguuacauuuuccuccucuguaguuaaguuuccua

SEQ ID NO: 4199066 - RNA, 109 nt, Human
uagguaauauauaaauguaagauuuuguacauuauuucaucagucaucugggcccaaggcuagauaucuggaaaaaauguauggauggacuuaauuuuauugauacuua

SEQ ID NO: 4199067 - RNA, 79 nt, Human
uagguagaagaucucaagucacacagccaggcauaauguugccaauuauaagcccugugaacuuaagauuccuuaucug

SEQ ID NO: 4199068 - RNA, 81 nt, Human
uagguauuuucacaguuucugaacacuuugcaaguuggacaauaaaacuaauuuuuaauaugaaagaaauuguuuagccua

SEQ ID NO: 4199069 - RNA, 93 nt, Human
uagguccccauacauuuucuaugacauugguugugugccaucuggcucaugacuuuccagcaauuucauggauaaaagauguauaauaaucug

SEQ ID NO: 4199070 - RNA, 62 nt, Human
uaggucuguguucuuuagagguuuuuguugguaggaacauugaaccaguagacacaaaccua

SEQ ID NO: 4199071 - RNA, 56 nt, Human
guuaagagacaaaaggaaaucuggagagaucuagauccauuuucugucucuggaac

SEQ ID NO: 4199072 - RNA, 66 nt, Human
guuaagccuaauggggccauuuaguucauuuucaagaaugcuuaaaaggcugcguuagaaaauaac

SEQ ID NO: 4199073 - RNA, 74 nt, Human
guuaagcuaaagugaaguucagaauggcuuguuaacuggguuuauuagcuguugaccuucccuuucagcauaau

SEQ ID NO: 4199074 - RNA, 61 nt, Human
guuaaggaacuaguacucaggcucucauccaaguggcugagggacuugcuaguucucugac

SEQ ID NO: 4199075 - RNA, 59 nt, Human
guuaaguaaacuaugauuuauccgucuaauggaacacugugaaucauaguuugcuuuac

SEQ ID NO: 4199076 - RNA, 66 nt, Human
guuaagucauagucuaacccagccaggaguguguucagccuggaaaaagguggacggugacugcac

SEQ ID NO: 4199077 - RNA, 67 nt, Human
guuaaguuccacagugagauaaaagcaaguaugacuaagcuugagucuuuuauccugggaauguaau

SEQ ID NO: 4199078 - RNA, 95 nt, Human
guuaaguugcucaauugauuuuucacugauagaaagaauauagauuccacccaugggucuuaguuuuuuucucucuugaaagagagagacuuaau

SEQ ID NO: 4199079 - RNA, 112 nt, Human
guuaaguugcuugaaaaaaaauacuauaaaacucugugacaaaaacacugauuauuucuaaaaggucaauugaaauggacugauuaugcuuugucauuaaguggcccuuaac

SEQ ID NO: 4199080 - RNA, 121 nt, Human
guuaauacaaacagaaaagcauacagcagcccuugcuuugcacacuucugauacaaaugaguuucaguuaacacagcacugugcaaagcaaaggcugccuguauucaauucucaaaggagc

SEQ ID NO: 4199081 - RNA, 77 nt, Human
guuaauauauguaaaugcaucagugcuuagagcagugccuggcacauaguaaguucugaguaaauacuguuauuaau

SEQ ID NO: 4199082 - RNA, 78 nt, Human
guuaaugcagacaccgacacucagauuaaugaaaggaagcaauuuauugaacugauauuugguguagaugucauuagc

SEQ ID NO: 4199083 - RNA, 75 nt, Human
guuaauguuuguaagaaggugaaacugauuaucuugacuuacauagucaguuucuaaaucuuaccaauucuuagc

SEQ ID NO: 4199084 - RNA, 92 nt, Human
uaucuacugccagaaaacucacaacacuuaugaaauguagguugcuuuauucaagcacuugauuacauuagugccugccugguccaaagaua

SEQ ID NO: 4199085 - RNA, 59 nt, Human
uaucuauaaguacuaacaugguauuugucacugaaaaucuauguguguguguguaggua

SEQ ID NO: 4199086 - RNA, 77 nt, Human
uaucuccacaaaggaacugcauuuugaaguuggaguaagccacucugacauuuaaaaagcaauucaguggaaaggua

SEQ ID NO: 4199087 - RNA, 56 nt, Human
uaucuccaucuggagagcaaaauaaucacuuauaauucugcauuaagguggagaua

SEQ ID NO: 4199088 - RNA, 106 nt, Human
uaucuccccuggaacacagaguauuugaagcauuugaagaauuuuuuucagguuauguuuaaaauuaaaaccaacucauguugugaaaaacucaagggcacggaua

SEQ ID NO: 4199089 - RNA, 103 nt, Human
uaucucuauguacauuaagagaaacaggaauugagucgcuugcugaaaacuucuaaaaaguccaugacaagacuucagaucuuguucuuuuguguaaaagaug

SEQ ID NO: 4199090 - RNA, 86 nt, Human
uaucugaacuguuguaaagacacugguuuuaaucauuucucagaucuauugaaauauugaugcucuuggugcuuuuaagguagaua

SEQ ID NO: 4199091 - RNA, 64 nt, Human
uaucugcuguugaugaacauuggaagaaaagcuacaucuuuucauguacauucggcaacagaua

SEQ ID NO: 4199092 - RNA, 98 nt, Human
uaucuggcaagauuccugacaauuuagcaauugauucucauaagccgguucuaucuggcucuaagaaaucauugcuuauagguacucuagucaaggua

SEQ ID NO: 4199093 - RNA, 62 nt, Human
uaucuggcuccuacacuugaagaggcaauauuccuccacucuaauuauccuagggccaggua

SEQ ID NO: 4199094 - RNA, 71 nt, Human
uaucuuacuuauuagcauaaguguucggugcacuuuuuguugcuguggaaauuuauguuaguuguagggua

SEQ ID NO: 4199095 - RNA, 79 nt, Human
uaucuuagagcaguucacagccauguucaugugcaaggccuuccugcacugguacguagguuggggcauggaugagaug

SEQ ID NO: 4199096 - RNA, 56 nt, Human
uaucuucaggcccccuguuguuagcacuacauuuuggcagcacuaccugaagcaua

SEQ ID NO: 4199097 - RNA, 66 nt, Human
uaucuucuagagggguagacauauuauuugggauacuucuccagucucaucuuucccugggagaug

SEQ ID NO: 4199098 - RNA, 126 nt, Human
uaucuucugaggucacccugagugaggcuuugcuccuacccagcucuccaggggugaaugaccacgcccaagggguguugauggaggaaaagauugaggucacaugagggagguuucagcaggaug

SEQ ID NO: 4199099 - RNA, 67 nt, Human
uaucuuuaggaaguuucagauaggaauguuaagguauuauuucucauuuguaauuuacuagcagaua

SEQ ID NO: 4199100 - RNA, 90 nt, Human
uaucuuucuuucacuuauuucuugaguagcauuuauggaaagccagcggcgguguuggaugguguuuucagggugggagugacauggaug

SEQ ID NO: 4199101 - RNA, 86 nt, Human
uaucuuuguguagguacauggggugugugcacgucuaucuccacauguauauaugugugugcacaucugugugugccuugaaggua

SEQ ID NO: 4199102 - RNA, 95 nt, Human
uaucuuuuauucauguuuagcuuucagaauccacugaguguuuuaaaugguaaugaaaaggcucaaagguugauagcugugcuuggagagggaua

SEQ ID NO: 4199103 - RNA, 72 nt, Human
uaugaaaggguaucucauugugauuuuaauuuacauuuuaaaauuauuaguuaaguugggcaucuuuucaug

SEQ ID NO: 4199104 - RNA, 79 nt, Human
uaugaagaaauacccagcguuagugagacagaaggcaaaaggcauguuuguacacaaccugugguaguauauuuuggua

SEQ ID NO: 4199105 - RNA, 65 nt, Human
uaugacaccauuuuggucagugauggacugcauauaugacaguggucauuauuaaaauuguuaua

SEQ ID NO: 4199106 - RNA, 72 nt, Human
uaugacacgcuuagcagagugaccugcgaccaguggggggucaggacauaaggucauuguuaagucaccaua

SEQ ID NO: 4199107 - RNA, 56 nt, Human
uaugacagucggcucuugcaagcugguacaagccagcucuagcaacccacugcaug

SEQ ID NO: 4199108 - RNA, 70 nt, Human
uaugacauuucucugauuuguggccaauuacggagguuauaaaauggcuguuaaucagggaaaugccaua

SEQ ID NO: 4199109 - RNA, 67 nt, Human
uaugacuuuguaaaguuggguucuucuuugaguucagauagucgaaggaaccucaauuuucgucaua

SEQ ID NO: 4199110 - RNA, 70 nt, Human
uaugagaauuugcuaauuggcuguuguuaaaauuaugacacuuaucaccuaaucaguaaauguucuuaug

SEQ ID NO: 4199111 - RNA, 69 nt, Human
uaugagagggccaguaaauguuuccucaggacacuucuuagaggacaaagucugugccugucccucaug

SEQ ID NO: 4199112 - RNA, 69 nt, Human
uaugagauguuguaaagaguuccaugucuaauagauggaugauaucuaaauucguuugcaacacugaua

SEQ ID NO: 4199113 - RNA, 57 nt, Human
uaugagcaagaguuugugaagggagauagaaaguccugacuacaacuguuguuuaua

SEQ ID NO: 4199114 - RNA, 74 nt, Human
uaugaguacugugaacgagaauuaguuacuuaaccucucugagcuucuauacucucauuuauaaagugcugaua

SEQ ID NO: 4199115 - RNA, 68 nt, Human
uaugagugggggcaggcagugcuaggaagagccauugccuuuuagauugugaccuccccccauccaug

SEQ ID NO: 4199116 - RNA, 57 nt, Human
uaugagugugugugaugugugugaaauucucuccuuacccaguuccacacacugaug

SEQ ID NO: 4199117 - RNA, 68 nt, Human
uaugaguucauaaugacacugaaggaaaaacuaauuggucaccauuuggaggucauuaggacauuaua

SEQ ID NO: 4199118 - RNA, 70 nt, Human
uaugaguugcucaggcuuagagcuacuauaugacagaguuaagugagagaucugucugaagcaucucaug

SEQ ID NO: 4199119 - RNA, 62 nt, Human
uaugauagugagggaagucauagucaucugaagugaugucuagcacaucaucucacugcaua

SEQ ID NO: 4199120 - RNA, 76 nt, Human
uaugaucuaauugugugaugaggcuacugagaaaucuaaugcaaucuuaugcuucauuaauagaauuaguauugug

SEQ ID NO: 4199121 - RNA, 87 nt, Human
uaugaugcccuggucuugccaaguucagggagcugggugccaagucuaucagcauuccucuggggccaggccaacaaagguagcgua

SEQ ID NO: 4199122 - RNA, 130 nt, Human
uaugauuauuuuucucgauaaauuauuuuugcucuccaagagugauucuaguuagggaauaugacaucaauucccagaguaggcauuaacucaugguagauuggaaggcugaagaucauaauauuucaua

SEQ ID NO: 4199123 - RNA, 56 nt, Human
uaugauuuuacccacagcagcauuccauggagggcagcuacugugggaaaauugug

SEQ ID NO: 4199124 - RNA, 63 nt, Human
uaugcaaaucauuagauuuccugcauuuagcuggcaggaaauauugucuaaauggagugugua

SEQ ID NO: 4199125 - RNA, 58 nt, Human
uaugcaaugcgcugacaugcagguugauugaaaggcuucauucacaggguauuguaua

SEQ ID NO: 4199126 - RNA, 59 nt, Human
uaugcagcaccacucacugcagaagacuugucucuucccgaagugaguggugcugcaug

SEQ ID NO: 4199127 - RNA, 79 nt, Human
uaugcauagcuucuccuauaaagugugguuuccguggcaacagcaagggggaaacaggugugcggaaagcugugauaua

SEQ ID NO: 4199128 - RNA, 98 nt, Human
uaugcaugauguggucugcacuugcacacauguacauguguaugguguguuauuuuacugugugugugugugugugugugugugugugugugugugug

SEQ ID NO: 4199129 - RNA, 60 nt, Human
uaugcauuaucgucuugauccucuauauaaaacuguacaggcauaaugaugauaaugaua

SEQ ID NO: 4199130 - RNA, 59 nt, Human
uaugcauugugagacugugggaauggccucuucagucuccccaggaucuccagugcaua

SEQ ID NO: 4199131 - RNA, 81 nt, Human
uaugccagauugauuuuggucuuuuguaaguuaucucaggauuuguaggaaguuacagguagaccacaguuauaagguaug

SEQ ID NO: 4199132 - RNA, 61 nt, Human
uaugccaggaccauagguuuuaacaacuguauaguuagaaccugaacuagggucuugcaua

SEQ ID NO: 4199133 - RNA, 100 nt, Human
uaugccaguacagcuuucauuaaaaauuccaaaucucaggggcuucaggagcuuaaaguauuuaaauuucaauagaaaguugguacugaaguuaagcgua

SEQ ID NO: 4199134 - RNA, 59 nt, Human
uaugcccuuacaaugagcacaagcccauauugcuaaauuguguaucauuuuaagggaua

SEQ ID NO: 4199135 - RNA, 130 nt, Human
uaugccuuuuauuuuaaauucugaauuuaaauuuuauauugggagucguuuugauucuugaaaaaugcguuuugagcugauuagagcuucccaauuaaaacgguacaacugaauauauuauaugggcaug

SEQ ID NO: 4199136 - RNA, 62 nt, Human
uaugcgcacaagcacgagcagcgugcgugcgugcgugcacgaugcgugugugugugugugug

SEQ ID NO: 4199137 - RNA, 80 nt, Human
uaugcugacugguaauggcuguguauauacggauucuguagacaaaugaaaguauauguauagccagucuuuaggguaua

SEQ ID NO: 4199138 - RNA, 84 nt, Human
uaugcuguuuaaccagaaagguacucaucccaauaaaauccaguaauuagggcaguacguuuucuuaguuauaaaaucaguaua

SEQ ID NO: 4199139 - RNA, 59 nt, Human
uauggagaagauagugggagaacagauguccuuucauucucugagcugcuucuugcaua

SEQ ID NO: 4199140 - RNA, 70 nt, Human
uauggaugccugggccuccuuccaagaaauucucacccuguuugacuggaauggggcccggacauugaua

SEQ ID NO: 4199141 - RNA, 71 nt, Human
uauggcaccaaggcauucuugcagguagggaacaaaaaguuuaccaccucauuauuccuggcuuguucaua

SEQ ID NO: 4199142 - RNA, 128 nt, Human
uauggcauagggacuacguuccaggagccaguguuccaagaggaccagaaagaaguuguauaacccuuuauguacaaguuuuggaagucuuaaggagucacuuucuuggcaguuacagcccugccaua

SEQ ID NO: 4199143 - RNA, 71 nt, Human
uauggcauucuguuuaauacacgaaagguuuccacuugauauacauuguguuaaaacagaagauagccaua

SEQ ID NO: 4199144 - RNA, 63 nt, Human
uauggcauuuagaaaugucagaccaagguuuuaaaggcccuuugaacauuucuagauuacaua

SEQ ID NO: 4199145 - RNA, 74 nt, Human
uaguuuuuugguagcuauuaacuuugccccacuagacacaaauaagcagaguuccagcugugaccagaaaauug

SEQ ID NO: 4199146 - RNA, 72 nt, Human
uauaaaaauggguauguuauuauuguuauaguuacaggaacuauuuagcaaguaugauacuccaugaguaua

SEQ ID NO: 4199147 - RNA, 55 nt, Human
uauaaagagucucaaagaaguuggcuggauaaagccugcuguggaagucuuuaua

SEQ ID NO: 4199148 - RNA, 109 nt, Human
uauaaaguagcuuguaaagacaaguaauuggacccagaagguggccucugucacaaucuaagcaagugauggccuggcugguucaguacccuuugcacccugcuuuuua

SEQ ID NO: 4199149 - RNA, 89 nt, Human
uauaacucuucuauagaaauggcucuguuggcccaagaccucggaugccaguuuucagccaggagcacauuuuugcagggaggguuaua

SEQ ID NO: 4199150 - RNA, 81 nt, Human
uauaagcccuggccuauuuaguuaucuuucauaaaauaaaauguaauaacuuauuucaagaucuuuggguaggcuuuugua

SEQ ID NO: 4199151 - RNA, 93 nt, Human
uauaagguagucuugauauuuuugaaggcugaaagagugaaaaaaacauaugccauuagcuagaaauaagauuaacucaagacugcacuugug

SEQ ID NO: 4199152 - RNA, 101 nt, Human
uauaagucuugcauggacauguacuucaauuucucuugaguaaauaccaaguaauaaaaugaggauauguuuaacuauguaaaaacucugucagauuugua

SEQ ID NO: 4199153 - RNA, 63 nt, Human
uauaagugugucagcuuccaacuuuacugauuacagcaguuugucuaugcugaugcauuugug

SEQ ID NO: 4199154 - RNA, 96 nt, Human
uauaaguuuguaauugaaugagaaguuauugccauguaauugacuaacagguguauguuaugguaaugaguuugaaucauauucaguugaauuaua

SEQ ID NO: 4199155 - RNA, 69 nt, Human
uauaaucugugugugugugugugcaggaaggaaaauggcuuugcacacauuaaggauacacagaaugug

SEQ ID NO: 4199156 - RNA, 87 nt, Human
uauaaugaccuuuaauuuauuuggaaacaucucagaaaauauaaaguuuuguauaaggaguuuaccagaguucugaagauuauuaug

SEQ ID NO: 4199157 - RNA, 117 nt, Human
uauaauguuuuaagaggguuuacgaauuuguguuaguccacguucaaagauguccugggccauaugcggcccaugagcagugggcuggacaaacuugcuuucugcuucugcguuaua

SEQ ID NO: 4199158 - RNA, 55 nt, Human
uauaauuaguaaauggcagauuugggacuuaaaccaugccauuugacugaaugua

SEQ ID NO: 4199159 - RNA, 70 nt, Human
uauaauuuugcaguaaauuuuauuugugggugauggaacuguuucuuucagagaaaauuugcugauuaua

SEQ ID NO: 4199160 - RNA, 68 nt, Human
uauacaagaggugagaugagcaggggacugccuuucccauccugucuaucagccucccuucuugagua

SEQ ID NO: 4199161 - RNA, 87 nt, Human
uauacaagugucuguuuguaucccugcuuucaauucuuucggguguaccccugggauugaauugggggaucacauaggcauucuaua

SEQ ID NO: 4199162 - RNA, 66 nt, Human
uauacauauauauguguguguauauauguguaucucuguguguguaaacauauguauguauguaug

SEQ ID NO: 4199163 - RNA, 88 nt, Human
uauaccuagcuagcugcucaaguauauggacccacaagaaucugaugaguccaccuuaguauaugggagucucuggcuuuaggguaug

SEQ ID NO: 4199164 - RNA, 93 nt, Human
uauaccucauuuacuuuucacuucacauuagcuaaaagggaaacuaggaaauuuucuuuguagcuaaugugaagugaaaguaaaugagguaua

SEQ ID NO: 4199165 - RNA, 74 nt, Human
uauaccugcucccaagucuucacucagguucugcucuugggagagaggaaacccaaacuaagacaguagguaua

SEQ ID NO: 4199166 - RNA, 67 nt, Human
uauacucacaaacauugccauguagucagaaguuggagaacagcuguuguuacaaugcaagaguaug

SEQ ID NO: 4199167 - RNA, 55 nt, Human
uauacugaucacugaggucaucuuuuccucucaugugaccacagugcuuaauaug

SEQ ID NO: 4199168 - RNA, 55 nt, Human
uauacugucgcauuacacucacaugaaugugugaaagggaauugaagacagugug

SEQ ID NO: 4199169 - RNA, 78 nt, Human
uauacuugugugccuguguguguccguguguacacaugugugcgccgacacagccagguguuggccaaugcaggugug

SEQ ID NO: 4199170 - RNA, 87 nt, Human
uauagauagacaaaaaugacagaggauuguaaagaggccccaugguuuugggagcuauucccuggcaaucccuuguguuugauuaua

SEQ ID NO: 4199171 - RNA, 61 nt, Human
uauagcaugcaucggugcuucauccuuuuuauggcugaauaacaguccaugcauggcuaua

SEQ ID NO: 4199172 - RNA, 57 nt, Human
uauagccaucuaaaggacaaucacuccagacaagugcuguccaacagacuggccaug

SEQ ID NO: 4199173 - RNA, 94 nt, Human
uauagcuggucucugguauaagcuuucaguaaauuauaauuuggccacaugccaaauuguggcgucuguaagaguuuacugugaggccucuaua

SEQ ID NO: 4199174 - RNA, 94 nt, Human
uauagggccgggugcaguggcucaugccuguaaucccagcacuuugggaggccaaggcauguugggagcaggccccccaaaaucuggccauaug

SEQ ID NO: 4199175 - RNA, 87 nt, Human
uauagucacuggaagacacuguaacucuguaauagugauuucaucaccauuauugcugacuuguucaguguuauuaugagugcuaua

SEQ ID NO: 4199176 - RNA, 77 nt, Human
uauagugauuagaaaucaugucuuauuucuaucaacccauaacaagauggagucauguaagaguuuaaauuacuaug

SEQ ID NO: 4199177 - RNA, 79 nt, Human
uauauaucuguccauuuuccauuuuggcaaaagauacauggaguauuugguaggccaggaaagugggucuuaguauaug

SEQ ID NO: 4199178 - RNA, 89 nt, Human
uauauauguguguguguaguuuguguguauauguauauagaugcacauaugaauauacauauauacauacauacacacacauauacaua

SEQ ID NO: 4199179 - RNA, 115 nt, Human
uauauauuaaguuggugcaaacguaauugcaguuuuugccauuaagaguaauggcaaaaccggauuacucuuaauggcaacaacugcaauuacguuugcaccaaccuaauauaua

SEQ ID NO: 4199180 - RNA, 103 nt, Human
uauaucuccauaaguugaacugaaaaauaccucuguaaguaaagauucaacccaaggguuaguuuuuacugcgaguuauaaacuucaagaaacuggguaugua

SEQ ID NO: 4199181 - RNA, 83 nt, Human
uauaugacgcaugaccuuuacacaaugauuuucuuuauccuacuguaaaucuuagucuugguagguggcuugggugucaagua

SEQ ID NO: 4199182 - RNA, 55 nt, Human
uauauguaagcuauguaagaguugaauuuaguugcucuugauugguuaacauaug

SEQ ID NO: 4199183 - RNA, 97 nt, Human
uauauguaguucuuaguuacauccaaaguugaggugccugcaguauuuucauaagaaggcggaucugacuuucagauugguggugaggacacgugua

SEQ ID NO: 4199184 - RNA, 77 nt, Human
uauauguauauuaucuuauguugucgccaaguguuucaccugccuugucucuccagcaauaagaagggauacaugug

SEQ ID NO: 4199185 - RNA, 103 nt, Human
uauauguguauguauauagauagauauguagauaucucauuaugaucaauuuaaaggacauaaucagauguguacauaagagcauuuguuacauucauaugua

SEQ ID NO: 4199186 - RNA, 88 nt, Human
uauauguuuagguuuggggggaaaaggguugucuuucuuagaaacacaauaaauuuauccuuugaaucccuccugaaucaaccauaug

SEQ ID NO: 4199187 - RNA, 72 nt, Human
uauauguuuugugcuucauugguagagcaguugcaacagagauuguauggccugcaaagccuaaaauauaua

SEQ ID NO: 4199188 - RNA, 64 nt, Human
uauauuaugcauggucugaagucaaccucuaaagagagguugucuaauugagcguuguaguaug

SEQ ID NO: 4199189 - RNA, 86 nt, Human
uauauucaaauagaugacaggauauuaugauagauucuuucuauaaagcaguuuggcaguuuguuuuuaaaaacuauaugaaugua

SEQ ID NO: 4199190 - RNA, 61 nt, Human
uauauucucaugcugccuauaucuguuugggaacuggagagaaggcagucauuggaauaua

SEQ ID NO: 4199191 - RNA, 84 nt, Human
uauauucugcauuccacauaaagcgauaacaggaaaacauaaaauuccacuaacuucauuauuauuuguguguguguaggugug

SEQ ID NO: 4199192 - RNA, 64 nt, Human
uauauugcuucccacaaagauguauugacucuggaaacagcauggguuaguggaaagcagucua

SEQ ID NO: 4199193 - RNA, 70 nt, Human
uauauuggcgcacugccucuguuguuuuccuuuucgcagaauacaauuagugaucagugaugccuuuaua

SEQ ID NO: 4199194 - RNA, 109 nt, Human
uauauugucaaccaaccacagcuagacuaauugcugggaaucucaagauaaauuuuauaaaaugucucuacccacaagugguuuacugucuguuaaggaagauagagua

SEQ ID NO: 4199195 - RNA, 79 nt, Human
uauauuguucugccucuuaaguggauggaguggauucauaauccuuagcuccagcuauugagugggcaagggacuggug

SEQ ID NO: 4199196 - RNA, 94 nt, Human
uauauuucuaucucuauauguuacucuuucaagcagagauaaucuguucauaguaguguauauguagagaggacaaggacuuuauagacauaua

SEQ ID NO: 4199197 - RNA, 92 nt, Human
uauauuuuaguuuugaaaaugaugcuguaauuuggcagguuuauaacuuaccacuaauugaagcaauauuuaucaacugcacgugaaauaua

SEQ ID NO: 4199198 - RNA, 92 nt, Human
uaucaaauguguuuuauauguauauucuuccugaaguaagaaaaaguucuggaauuuugagucagagaaugugaauauuaaaccaucauuua

SEQ ID NO: 4199199 - RNA, 104 nt, Human
uaucaaauuuuucuuucaagaaccuggaaagcgguucauuuuguuuuaucgagcagauugugaaaagaguuuucuugcagaguuuuuguuuuauaaucaaaaua

SEQ ID NO: 4199200 - RNA, 130 nt, Human
uaucaaggcucucuuuuuugcucagcaguaaucugauucucuagcugugauaaacugcucugccuuuggccuucuaguuuagccauuuaggaauuggauuauugucucauaaaacagaggggcaaugaua

SEQ ID NO: 4199201 - RNA, 56 nt, Human
uaucaaugguuuauauucaagggaggaacaaguuuuuucuuggagaacuaaugaua

SEQ ID NO: 4199202 - RNA, 60 nt, Human
uaucaauugggccaaaugguacaaaggaucauguaacuagaggaguggcccaggauggug

SEQ ID NO: 4199203 - RNA, 56 nt, Human
uaucacauacuucucauccaggcuguucuuugggucgugggggcucaguugugaua

SEQ ID NO: 4199204 - RNA, 60 nt, Human
uaucacugaguuuugacaacuuuuauauaauugacuguaaaguguuuugauuuaguggua

SEQ ID NO: 4199205 - RNA, 84 nt, Human
uaucacuugaccuucccauuucugagaagugccuggucugccguguauagcaaacugcacuuacauagaggaggcuagguggua

SEQ ID NO: 4199206 - RNA, 58 nt, Human
uaucagaacacagccacagccauuuuuuuacauauugccuauggcugcuuucaugaua

SEQ ID NO: 4199207 - RNA, 61 nt, Human
uaucagagaugcacauuugguuuaugacacccaugucaguguaaauggugcauuucuuaua

SEQ ID NO: 4199208 - RNA, 130 nt, Human
uaucagcgguccuuagacaucugcguauaucaaaaucaccuggagaacuugguaaagcuggggcuucuaggagcuuuauuaacucuccaggugauucucguaaacaucauaguugagaacugcuucucua

SEQ ID NO: 4199209 - RNA, 61 nt, Human
guuaauguuuucucacagggagagucccuaauguuucuacuuuuugugcagcaacauuaau

SEQ ID NO: 4199210 - RNA, 70 nt, Human
guuaauucagucaaagaaaccauuugaucugaaugugugaccgaaugaccagugguuugacugaauucac

SEQ ID NO: 4199211 - RNA, 74 nt, Human
guuaauuccucugagcucuaucugugggaaugaugaauucuagccauuauggaguucugugagguuaaauuaau

SEQ ID NO: 4199212 - RNA, 58 nt, Human
guuacaaaggaagcuucacugcaugcauucuuuugcccaguggggaucucuuuguagc

SEQ ID NO: 4199213 - RNA, 90 nt, Human
guuacaauaaucacuggaaaaaguucaauggaaaagcuuuaguuccuuugaaucuguaguuuuucuugagcuaaucagucauuugauaac

SEQ ID NO: 4199214 - RNA, 57 nt, Human
guuacacacaauauauccuaaauucacuugguaguugggguaacuauguguguuagc

SEQ ID NO: 4199215 - RNA, 66 nt, Human
guuacacagcuaagcuucuccuggguagaacaaacuauuugcggaaauuugguuuaguuuuguaau

SEQ ID NO: 4199216 - RNA, 68 nt, Human
guuggagucccagccgcagagagcagggcaucacggccaccugcucuagacucugggaagguucuagc

SEQ ID NO: 4199217 - RNA, 68 nt, Human
guuggauggcaucguccugggcauagggagggaugaguucuccugccaggagaugguagccauccugc

SEQ ID NO: 4199218 - RNA, 105 nt, Human
guuggauuuaucaaccucuuaccaugauuuaaaauacuguguuaaguuuggguuuuaaucuaacugaaacguauuuuugagauuggugugagguugaaaucuaau

SEQ ID NO: 4199219 - RNA, 79 nt, Human
guuggcacugcaggcagacuuccugcuuggaucucuccuaucuggagggaugagauggggacucugucacaugcacaau

SEQ ID NO: 4199220 - RNA, 81 nt, Human
guuggcagagccagaggucucucuauacugggaauaagcaaugagcuggaaguuccauuaggggaucuggcucuugaggac

SEQ ID NO: 4199221 - RNA, 109 nt, Human
guuggccaggcuggucuugaacuccugaccucgugaucuguccaccucggccuuccaaagugcugggauuacaggcaugagucacugugccaggccacaccuggcuaau

SEQ ID NO: 4199222 - RNA, 62 nt, Human
guuggccccugagcuucauucugugugauccauacacagcagagacacucaggaggcaaugc

SEQ ID NO: 4199223 - RNA, 58 nt, Human
guuggccuugaggugguagaguucaucgaacuucaugcugauauccucgauggacagc

SEQ ID NO: 4199224 - RNA, 65 nt, Human
guuggcugagggcaaugacauggcccaguuuuccuuacuauuuacuucuuuggccuucagccaac

SEQ ID NO: 4199225 - RNA, 69 nt, Human
guugggaugucugggucuuccuggcuucaccugugacuagggaagcucagaguagcucagcguccucac

SEQ ID NO: 4199226 - RNA, 70 nt, Human
uauuuugcguugagucagauuucccucguguuaagacagucuccugggaaugucuaaaaaauguaaaaua

SEQ ID NO: 4199227 - RNA, 55 nt, Human
uauuuugcuuuggcccuuaagugguagccuacugucuggguucccaagcaacaug

SEQ ID NO: 4199228 - RNA, 56 nt, Human
uauuuuggcucucagcaguuagcuuuucuggagcggaauagcugagggcaagagua

SEQ ID NO: 4199229 - RNA, 80 nt, Human
uauuuuuaagugcauuuuuccucugguaaguuaugaugaauuauaugcucuguaaagaagagaaaugcauaguagauuug

SEQ ID NO: 4199230 - RNA, 84 nt, Human
uauuuuuaauuuuaguacauuuaguuuaugaacaugcaauuuguggaugucuguggcauuauauguuuuauaaaauugaaagug

SEQ ID NO: 4199231 - RNA, 105 nt, Human
uauuuuuauuuuugcuuuucuccuuaaauauuaguuugaccucuggauugcaaugcaaugcacauguuguaauaaauaaaaggggcuuggauaaaagugaaaaua

SEQ ID NO: 4199232 - RNA, 61 nt, Human
uauuuuucauuugcggcauggaguucaagcuccuagaucagagaugcugcuaauuaaaaua

SEQ ID NO: 4199233 - RNA, 74 nt, Human
uauuuuucugaagagagggaaacaauuggaauugaagugacuaauuccuuuugcaagguccucuaggaaaaaua

SEQ ID NO: 4199234 - RNA, 73 nt, Human
uauuuuuuaguguggggcgguaguuugaugauuaaacuguaucugaacuuuacacugcuuuacaugaaauuua

SEQ ID NO: 4199235 - RNA, 77 nt, Human
uauuuuuuaugcuuuaauuguuagaaucuaguuuaucagggcugauaccagggcugacaguaaaaguaugagagaua

SEQ ID NO: 4199236 - RNA, 97 nt, Human
uauuuuuuccuugaccauguagaaacagacaucuuuuccucacuaaaaacuuaaaaaaggaaacauuguaauuuuagcauggauuaaagaaaauaua

SEQ ID NO: 4199237 - RNA, 65 nt, Human
uauuuuuugaacauuuucuauguuauagauauauuuguggaugcugagaauguucaugguaaaua

SEQ ID NO: 4199238 - RNA, 78 nt, Human
uauuuuuugcuucccauauaacuaauuucugacauauaagauuuauguagacauuauugggugggacuucuaggaaug

SEQ ID NO: 4199239 - RNA, 63 nt, Human
ucaaaagcuguuguucauccugaauugaauuuucuuaguuuggguggaacagagucguuuuga

SEQ ID NO: 4199240 - RNA, 90 nt, Human
ucaaaaggcgcacacagggcacaagcaggcagcaaccucuaugagucagagccugcuuggccuacuuguccuuugcaccaugucuuuuga

SEQ ID NO: 4199241 - RNA, 60 nt, Human
ucaaaauuuuauuccuguauguuuuacacucaguuugagcuuuaagggauaaaaugauga

SEQ ID NO: 4199242 - RNA, 59 nt, Human
ucaaacagcucguggcugcccuugugcccagcgcugugggcaugagcgagcugcuuuga

SEQ ID NO: 4199243 - RNA, 57 nt, Human
ucaaacauugcacuuucugcuauguugagaagugacauaaguugugcaacuguuuga

SEQ ID NO: 4199244 - RNA, 56 nt, Human
ucaaaccuuguuccagucaacucugugcgugaguagggagggggaauuagguuugg

SEQ ID NO: 4199245 - RNA, 56 nt, Human
ucaaacucauucuaaguauaccaaagccaagauuauuggcuuuggggaugauuuga

SEQ ID NO: 4199246 - RNA, 110 nt, Human
ucaaagaacuggugaaaugacuccuaaguaaguugacuuucagagaauuggcugcuucucaugagggaaaaucaauuucugcuucuuguugucaucuguuuacaauuuga

SEQ ID NO: 4199247 - RNA, 69 nt, Human
ucaaagacauucacaaauguucacuuuuguuggauugcugagugagcauauuugugugauguuaaagga

SEQ ID NO: 4199248 - RNA, 66 nt, Human
ucaaagagaaguuuuucuuauuacauguaauacauaguucaugacggacaaagacuucucuuguga

SEQ ID NO: 4199249 - RNA, 88 nt, Human
ucaaagagccuggaccugggcucugagcccuguacaaggaugagaagcagaggcagcacuucagguuuuuguccagguuugaucauga

SEQ ID NO: 4199250 - RNA, 76 nt, Human
ucaaagaguugaggcaguuauccaggaggucugaaaucacagaagguguuuggagagcgugcuuagcacucuguga

SEQ ID NO: 4199251 - RNA, 58 nt, Human
ucaaagcauuugguucugaagacucugaggugcagagcucuuuugaugaagguaguga

SEQ ID NO: 4199252 - RNA, 55 nt, Human
ucaaaggaaacgugguccuggcccucgagggggugccaguccaaauuccuuauga

SEQ ID NO: 4199253 - RNA, 66 nt, Human
ucaaaggaagaacaaagcucagccagaugcccaaaauauggcuucauuauuguuuuuccuccauga

SEQ ID NO: 4199254 - RNA, 72 nt, Human
ucaaaggggccaccuguggcacccugggucugcaccacucaguucccccagaggugcccaggggccccagga

SEQ ID NO: 4199255 - RNA, 65 nt, Human
ucaaaguaccuucauauuauucaaaguuucgcauagauggugcaauauuaugaaagguaaaauga

SEQ ID NO: 4199256 - RNA, 62 nt, Human
ucaaaguagaguucagugcagccagugcaggugugaaugcucaaaacuggauacuacugugg

SEQ ID NO: 4199257 - RNA, 65 nt, Human
ucaaagugcucuagaaauugucagugguuuacaugaaguggccacgggugucuggagcacccuga

SEQ ID NO: 4199258 - RNA, 64 nt, Human
ucaaagugucuuuauauuugagaaaagucugcauuuguauuucucuuaaauagagccacuuaga

SEQ ID NO: 4199259 - RNA, 77 nt, Human
ucaaaguuccuuccuguuucuccugcaaaauccuugcaugugugcuggggguguguguggaggacaugagccuuuga

SEQ ID NO: 4199260 - RNA, 130 nt, Human
ucaaauccacuggggcaagccugcauacucagucucuaucuuggugauucacaagugguuaaggcuuugagaaaccuggcaguagagaccuguggccuugugcacucuggcauucucuacaucuguuuga

SEQ ID NO: 4199261 - RNA, 113 nt, Human
ucaaaugagcacaauaguccacuguaucuuuuccaaagucuaaauaacucagucuucauuagcacaauguugaggauaccaagugugaugguuaauuuuaugugucaguuuga

SEQ ID NO: 4199262 - RNA, 55 nt, Human
ucaaaugcaggucuggucuugguagaggugucccuccuccccuaccuccguuuga

SEQ ID NO: 4199263 - RNA, 85 nt, Human
ucaaaugguagugcaauguugcagaagcacauguuuacauguaaagauuauuuauacacaaggugugcauuuguaaacuauguga

SEQ ID NO: 4199264 - RNA, 66 nt, Human
ucaaauugaaauucuuugugguccaucacuguuaacacugcuggccuggaaggaauuucagugaga

SEQ ID NO: 4199265 - RNA, 65 nt, Human
ucaaauuuaagugaggucuuuguuaaguucuguaaauugagcuuauaaagacaaacacuauuugg

SEQ ID NO: 4199266 - RNA, 129 nt, Human
ucaaauuugaaugucuugcuuccccuucccuccuugguuccuggccccauccaucuucagagccaacuguuugaagacggaaggggccaggaaccaaggaagaggggaaaagaagacauucaaauuugg

SEQ ID NO: 4199267 - RNA, 65 nt, Human
ucaacaagccagauacuuggaaagacccugagggauuaggguucaaacugaaucugguuugaaga

SEQ ID NO: 4199268 - RNA, 78 nt, Human
ucaacaagccauaaggccucuucucucuggagauucucacugugguuuccagacuggaaggucugaguggucugagga

SEQ ID NO: 4199269 - RNA, 69 nt, Human
ucaacagcauggaguccuccagguuggugcaucucuaaacuugacccaccuggagauccauggugucga

SEQ ID NO: 4199270 - RNA, 119 nt, Human
ucaacauccuccuucuuuugagugcccauguuucccagaucuuggccuuggcucuucucacucaacacacaacucuucaucugaacacacuacuccauuuaccaucuccuggauguugg

SEQ ID NO: 4199271 - RNA, 76 nt, Human
ucaacauguggagaaauuucaaaagugagccauaaaacucauacaaaagguuauacaguuaaguuucuucaguuga

SEQ ID NO: 4199272 - RNA, 87 nt, Human
ucaaccaaugagaacugggaguugguggccaaauaccaagcuuccucaacccuugguaagucaagucucagucucucagagguuuga

SEQ ID NO: 4199273 - RNA, 71 nt, Human
ucaaccauuauuuucugagcacgugacagcauuggacucagugcugcauuggcuguagagaauaaugauga

SEQ ID NO: 4199274 - RNA, 92 nt, Human
ucaaccugaggauauaggagucauuuuaugggaacagauuugaaggcuuaucacuguuucccaaaguaagagguaccugugaccuguguuga

SEQ ID NO: 4199275 - RNA, 59 nt, Human
ucaaccuguggaagaugggaguggguggauccauacccagcuuucucacacuuggugga

SEQ ID NO: 4199276 - RNA, 77 nt, Human
ucaacuauugcuuuccagugggccccuugaaauaauuucugcacaugcacagguuggggggucagccaacuaguuga

SEQ ID NO: 4199277 - RNA, 57 nt, Human
ucaacucacaagaaugagcaaguucuuuggacuuaaguuguugacauucugaguuga

SEQ ID NO: 4199278 - RNA, 128 nt, Human
ucaacuccauucuauggauagaaaagcaguuucugagagguuaagcaauuugaccaaggucacaagguuaguugcuggcagacccuaggaguaggaaagcuagaguguuguguguggggaggaguagg

SEQ ID NO: 4199279 - RNA, 78 nt, Human
ucaacucuuucuucauacaauuucagacaucucucuauggauaagaagaugucagaacagguaugaaguuagggagga

SEQ ID NO: 4199280 - RNA, 87 nt, Human
ucaacugcuucugcaccugugcagguuuacaaaaaauuuuugccaaauugaauggaagauuugaaacacauagacagagguaguuga

SEQ ID NO: 4199281 - RNA, 76 nt, Human
ucaacugguuuuccagcuaguaagcaccugcauccugagagaacaggcuaagaugagacugugcugugagcguuga

SEQ ID NO: 4199282 - RNA, 78 nt, Human
ucaagaaaaugacgccaaccuuccccaggugcuccucaaucacuguguugucugucagagggauggucuuauucuuga

SEQ ID NO: 4199283 - RNA, 103 nt, Human
ucaagaacuaaucacacuucauucuguauuuuuuauucuucuuauggucaacacguaugaagcaguuaaggugcaugauaaucgaagugcuguuugugguuga

SEQ ID NO: 4199284 - RNA, 75 nt, Human
ucaagaaggguuuauuguuaauaaguuugaaaccacauuucaaauugucaucuugauaauguuagccuuuuuuga

SEQ ID NO: 4199285 - RNA, 96 nt, Human
ucaagaaguauauuauguccuccaguguguucucaaugaaaagaaaauuauuucuuucuuggggaacacacucuuauggcauuuuaacuuuuauga

SEQ ID NO: 4199286 - RNA, 87 nt, Human
ucaagaagucccagaagucacagagagaauauuguguuucagaaauuggguugaaauauugcuuauuggauagaggggauuauuuga

SEQ ID NO: 4199287 - RNA, 101 nt, Human
ucaagaauaauagaaaaugacuauaaauaggagauuguauaauauaguauaauagucuuuugagcaguuaccuauuuuguagaaauuuuuuaaggucuugg

SEQ ID NO: 4199288 - RNA, 65 nt, Human
ucaagaaugguuagaugucuggaaauuaagcucauaauuaucagauauaaaacugcaaaucuuga

SEQ ID NO: 4199289 - RNA, 56 nt, Human
ucaagccacuggcagaagauuacuuucuaagagugagagccuucccagggcuucga

SEQ ID NO: 4199290 - RNA, 69 nt, Human
ucaagccccuccuggaggcggaugcccaccuacguuucagcgugggaagccgaccccggggggaccuga

SEQ ID NO: 4199291 - RNA, 57 nt, Human
ucaagcccucuggguuaguuuagggagccacaguuugguacccagaguugggcuuga

SEQ ID NO: 4199292 - RNA, 65 nt, Human
ucaagccuugguagggucuggagucagacucagccaccacugaccuagccccuacuccaaguuga

SEQ ID NO: 4199293 - RNA, 58 nt, Human
ucaagcuacaggacaccucugcucaguuuugugcaagaggggagcaucugcuggcuga

SEQ ID NO: 4199294 - RNA, 78 nt, Human
ucaagcuuucacguaagucauuuaagguaagcucucugagcagcuuugaagucugugucuuuugaaugcaaagcuuga

SEQ ID NO: 4199295 - RNA, 103 nt, Human
ucaaggagcaugaacgguggcuggccaugugcauccaggcccugcagcgggaaguggcagaggaggaccuggugcagguggacagagccguggacgcccucga

SEQ ID NO: 4199296 - RNA, 95 nt, Human
ucaaggauacuugaguagaacugguuaucuaauauuauacauuuuauauauuggguaaagauccaguuuucauucaagcacauauauuuccuuga

SEQ ID NO: 4199297 - RNA, 97 nt, Human
ucaaggcuacuccuggugagagaauuugaguuaaauuuaggccauauacuuuguuuauauuuggcuaauuucucacucucuugaucacaagcuauga

SEQ ID NO: 4199298 - RNA, 116 nt, Human
ucaaggcugccaaaagaauuuacuguuuguuccagcccacaccugaagcuggagccccugcuucccagccucugugugaggguaggagccuaacguuaacucauguccagcuuugg

SEQ ID NO: 4199299 - RNA, 64 nt, Human
ucaaggcuuugugcugaguugucguuugaaccaagcaugauguuaucaagcacaaagcacgugg

SEQ ID NO: 4199300 - RNA, 105 nt, Human
ucaaggugaagaguggggaguugggagcagggauggaguacccaggauaaaucugagaaacagguuacugcaucgaaaugcuuuuauccuuccucaucccuaugg

SEQ ID NO: 4199301 - RNA, 55 nt, Human
ucaagucuugagggacagcauuccagcaccacugagugucauucccaagcuguga

SEQ ID NO: 4199302 - RNA, 64 nt, Human
ucaagugaucaaagugcuggaauuacaggcgugagccacugugcuggccuuuggugacuucuga

SEQ ID NO: 4199303 - RNA, 64 nt, Human
ucaagugcagaguuucucaguggaauuuucaagaagauuuacaaaggauuugcuuuucacuuga

SEQ ID NO: 4199304 - RNA, 62 nt, Human
ucaaguggaggcaguuuaagucugagaaaaauuauucuuucugaagaugcuguuuccaguga

SEQ ID NO: 4199305 - RNA, 77 nt, Human
ucaagugucaaucagcugugguaauuuggaaccauaguucauacauuuuuacuaacagcugaggauuugauauuugg

SEQ ID NO: 4199306 - RNA, 70 nt, Human
ucaaguuaggcgcagcacgugagaguuggcaguuuuccacccaccgaccugaguugcugugguuagauga

SEQ ID NO: 4199307 - RNA, 58 nt, Human
ucaaguuaggugguuguuaggaguaaaugaguuaaugccugcaaagugcuuagcuugg

SEQ ID NO: 4199308 - RNA, 57 nt, Human
ucaaguuucucucagauuauggggucauuuuagagacccaauuuaccaaagacuuga

SEQ ID NO: 4199309 - RNA, 109 nt, Human
ucaaucugggaagcucauacugguguacaaugcagcaguuuacaaagcaaucccaaugggguuguguacuagcugcuuguuuguuugcaagugcaauuccagauguuga

SEQ ID NO: 4199310 - RNA, 103 nt, Human
ucaaugaaaucagagauuuuuguuuguuuacugauauauugucagucccugccauacagucacuuaaaaauguguugaauaaauugugccucgauuuuguuga

SEQ ID NO: 4199311 - RNA, 56 nt, Human
ucaaugccuagagaggcugggugacuuccaaggucacacagcuggucagguacaga

SEQ ID NO: 4199312 - RNA, 85 nt, Human
ucaauuagcaaguuagacaugagugugcuuacaucugcccaugcagcugaaagcaauaaucucuguacugugguguuauuguuga

SEQ ID NO: 4199313 - RNA, 130 nt, Human
ucaauucauuaagcaaaugaauauuaguuuuuauuugucugcaugucaugucuggcugugguguacacuauaccaauucuauuuuggauugauugcugacagagaaaucauucauuaugcaugugaggaa

SEQ ID NO: 4199314 - RNA, 58 nt, Human
ucaauucuuauugguguucugcuauauaugagcuuugugaacaugaauggguuauuga

SEQ ID NO: 4199315 - RNA, 92 nt, Human
ucaauugaaaguguuuuuaugacccaagaagauaccaaugcucaguugaacauaauaacuggugaauuugcuugggcauaccacccaaauga

SEQ ID NO: 4199316 - RNA, 55 nt, Human
ucaauuugcaugugucuauauguguauaugugcugauauaggcauaguaaaauga

SEQ ID NO: 4199317 - RNA, 99 nt, Human
ucacaaaugcuuguuuaauuggccucuuagagguuaggguggacuuugaaaaucccuaagaacucugagggugcuaauuuuuuuuaccaagaacuugga

SEQ ID NO: 4199318 - RNA, 96 nt, Human
ucacaacuggaugagguagcugcuauuuguaguucaguuuuauaagaugagcaaagagaggcuacgagagguaaguuacaaccagcuagguaguga

SEQ ID NO: 4199319 - RNA, 59 nt, Human
ucacaagacagaaaacauuuagaagauagcuauuaucucauaaguuuuauguguuguga

SEQ ID NO: 4199320 - RNA, 57 nt, Human
ucacaagagcuggacugucuuuucugaugcuguuguuuucacauccagcuuaugugg

SEQ ID NO: 4199321 - RNA, 82 nt, Human
ucacaagauuuacguguacucauuucuguaugucaugcacucaucugugcacaugcacauguggcuauguaauucuguguga

SEQ ID NO: 4199322 - RNA, 62 nt, Human
ucacaaggcagccugcuuccgcagaauuaaaagugggagugucuaaacuggcuuccugguga

SEQ ID NO: 4199323 - RNA, 59 nt, Human
ucacaauacucacucaauggcuucccuuccuggcagugugguuuuguguguguguguga

SEQ ID NO: 4199324 - RNA, 69 nt, Human
ucacaauaugggugugggaacuggaccacagaguuacaguggucauuuccuccccaccacaucuuguga

SEQ ID NO: 4199325 - RNA, 59 nt, Human
ucacaaucugccugccagcagugcuucgugcucugcugaggcccaggagcacuuuguga

SEQ ID NO: 4199326 - RNA, 120 nt, Human
ucacaaugaaauguuucuacuuugcacccuuuggguucaguuguucaaccaguuacaauuaguuagauuaguaacugguugaacaacuguaaucaaagagcacagauugacuuguugugg

SEQ ID NO: 4199327 - RNA, 74 nt, Human
ucacaauguuuccaucugcuagguaaaugaaucaagaauaguuuuacauucauaauuacagagggaaaguguga

SEQ ID NO: 4199328 - RNA, 63 nt, Human
ucacaauuguuuuuaggaucaagccuagagauaaagagccauggucucugaaaauaauguuga

SEQ ID NO: 4199329 - RNA, 82 nt, Human
ucacacaaggcaacgugcuuuagagagaugcuuguaauuucaaggauacaaagcagaugcguuggagcaguugccuaugaga

SEQ ID NO: 4199330 - RNA, 63 nt, Human
ucacacauauggcuuguggagaguuguaguaaguccugcuaugauuuccaaagucauuucuga

SEQ ID NO: 4199331 - RNA, 73 nt, Human
ucacacaugaguaaauacagggagguuuaacauaacuuuauuaucuugcugucuuuucuucucauugauguga

SEQ ID NO: 4199332 - RNA, 71 nt, Human
ucacacauuagccauuucaucagaaccacacaucguuuggcaguggagaugaacauggugauguuaaguga

SEQ ID NO: 4199333 - RNA, 88 nt, Human
ucacacauuagguuggugcaaaaguaauugugguucuuuccauuaaguguaaaacugcaauuacuuuugcaccaaccuaauaguuuga

SEQ ID NO: 4199334 - RNA, 67 nt, Human
ucacacauuccaaaaucaaggguauaagcaauuacagccaacucuugauuauccuuggcaaugugga

SEQ ID NO: 4199335 - RNA, 70 nt, Human
ucacaccugccuucagcauugccaugagggcugggcgagguggcccgugcaguccuggaggaagguguga

SEQ ID NO: 4199336 - RNA, 84 nt, Human
ucacacuaucauuuguaccauacuguuuauuacggaccaguucagauucgaugagaaacacaagggugcaaauaccagaaguga

SEQ ID NO: 4199337 - RNA, 78 nt, Human
ucacacugaguccugagaacauucuaauuuggaagucacauaaaagagaaaaacaggugucaugggagucagaaguga

SEQ ID NO: 4199338 - RNA, 60 nt, Human
ucacacuuaucccacucagucauggcaaagagaagacacuacuggcacugguaggugugg

SEQ ID NO: 4199339 - RNA, 72 nt, Human
ucacacuucccuccuggauuccagacugucaggagggaugccuccgaggugguguuuggaaggaggugcuga

SEQ ID NO: 4199340 - RNA, 55 nt, Human
ucacagaauaaauguacuggccauguugucaugggaaagucauuuacuuuuguga

SEQ ID NO: 4199341 - RNA, 57 nt, Human
ucacagacagugucccuuuguugggggagaccucaguggccucuggcuuugcuguga

SEQ ID NO: 4199342 - RNA, 60 nt, Human
ucacagaugaggauagguuuauauuuaaaggacaaauucugaacaaaguucuuaucguga

SEQ ID NO: 4199343 - RNA, 87 nt, Human
ucacagcaccucaucucuuucucagaugguggagaagcaaacgguuccuggcgucucgcuguggacagggagaaugaggugcucuga

SEQ ID NO: 4199344 - RNA, 57 nt, Human
ucacagccuggucacucugcccaauagcaaaucuggugcugaguugaauggcugaga

SEQ ID NO: 4199345 - RNA, 86 nt, Human
ucacagcuaaugagcagcuggaggccuuguuggaaguuaauaaacucaucuucagaggaggcaggcugugcugcaccuuguuguga

SEQ ID NO: 4199346 - RNA, 73 nt, Human
ucacaggccaguaagacuguguucaugccaaacacaacaguggaauaggcgaaaccugguuuccugcccuuga

SEQ ID NO: 4199347 - RNA, 98 nt, Human
ucacagggacuucccagggggcaguaggcauagaaagaagcaccaagaugaaggcuuggucaaucugaaaguagccugggccccauggagcucaguga

SEQ ID NO: 4199348 - RNA, 87 nt, Human
ucacagguaucccugcagggccauugugcagacgguccccaucuggaugacaucuguggcugcgcccugggggagcucuaccuguga

SEQ ID NO: 4199349 - RNA, 71 nt, Human
ucacaguauuuacuaucaccauuaacccauagagugaguuugguuuggugucuuggaaguaggugcugaga

SEQ ID NO: 4199350 - RNA, 64 nt, Human
ucacagugugaaccuguucacugucaccaacucacucaucacauuuggaacuuguucacuguga

SEQ ID NO: 4199351 - RNA, 69 nt, Human
ucacaguugagcagguugugcacugcaccauguuagcccugguacaguacacaaccugcccaacuguga

SEQ ID NO: 4199352 - RNA, 79 nt, Human
guugggccgggcacagguugagguagaugcucucuggcacuuugaguuugucauuggugaucugaugccugaguuuggc

SEQ ID NO: 4199353 - RNA, 86 nt, Human
guugggcgauggaggucguucuguggcgcucagccugcagcacagcuggccuggagguccagaacgugccuacucucauacccggc

SEQ ID NO: 4199354 - RNA, 62 nt, Human
guuggggagacuggccgagauccugcugggauggcgccuggucagugaugcuaucccccgac

SEQ ID NO: 4199355 - RNA, 74 nt, Human
guuggguagaagauauugcauauuggaugaguugcaaucccccaaccucucuuucagcauuguuucuauucuac

SEQ ID NO: 4199356 - RNA, 98 nt, Human
guuggguaggauuugcuucucugugcccucuacugucucagauucuauguaucugccagauggcagggguaccuggaagccaguagcccuuaccuggc

SEQ ID NO: 4199357 - RNA, 67 nt, Human
guugggucuaaaaugagucuuccuagguuagaaaaacuuuucaaauuagagacucuuuuaggauaac

SEQ ID NO: 4199358 - RNA, 80 nt, Human
guugggugcaccggccugggagguaggaguccugaguucaaagccagucucugccacuucuaagcugcgugugcuucaac

SEQ ID NO: 4199359 - RNA, 106 nt, Human
guugggugggggcaggaaagucggcgacucugagccaccagauccccaggaugccccguggggaggugcgcacagagcaucagcagccgccugcccgccggccggc

SEQ ID NO: 4199360 - RNA, 99 nt, Human
guugguagagaugccucugggggcuaguuguccugguagugaagcuauauguguugcaggucuucauucuugggaucagagagucagggaggugcuaac

SEQ ID NO: 4199361 - RNA, 103 nt, Human
guuggucaggcuggucuugaacuccugaccuugugauccacccgcuuuggcauccccaaagugcugggauuacaggugugagcagccaccaugcccagccaac

SEQ ID NO: 4199362 - RNA, 76 nt, Human
ucaauguauauauguguauauaugagugugugcauagguguauuugcacaaauuuguguaugcucacgcauuuuga

SEQ ID NO: 4199363 - RNA, 127 nt, Human
ucaauuaaaggauaauuuuuauuauuauguuaaaauguuuugauuaauguguaguuaagcagguguuaaacuagauuuuggccauuauacaagacauaagcaugguacuuaauuauauguuaguuga

SEQ ID NO: 4199364 - RNA, 60 nt, Human
ucaauucccauauuuuauaugauuuacuuuauaguaguaaaugugaaauguggggacuga

SEQ ID NO: 4199365 - RNA, 58 nt, Human
ucaauuggcuauucugacaccugaggagucagcuccccaggcucagcugagcucuugg

SEQ ID NO: 4199366 - RNA, 58 nt, Human
ucaggaaacuacaguugaacuagauccauauguggcuagaaaacauguagcuuucuga

SEQ ID NO: 4199367 - RNA, 118 nt, Human
ucaggaagcucauuucggucauguugcggugcuuugcuggaaucgaggaaugugcuuaauucgaaggugucuuugucgguuacagcaacgcugcugcugaaugccgugagaagccuga

SEQ ID NO: 4199368 - RNA, 57 nt, Human
ucaggaaggcgccccaucaggaaacaucuguuucuugccuuucaugcccuuuccuga

SEQ ID NO: 4199369 - RNA, 76 nt, Human
ucaggacaaacucuaaaguguggcuuauauuccagauucccuuuggggaucaggcugaagcuaggacuuugccuga

SEQ ID NO: 4199370 - RNA, 55 nt, Human
ucaggacagccagggugcagacucagggaagagcaggucggcccggcugugcugg

SEQ ID NO: 4199371 - RNA, 129 nt, Human
ucaggacuauuggaugagccaugaaacuguuuaugaacgguuuuuuauguuucuuaugcuuaacuggcuuaguugagcagccagugcagaacacauggaaaauguucuugcagcuuaccacaguucaca

SEQ ID NO: 4199372 - RNA, 66 nt, Human
ucaggacuccuggcuuucccucuuaggcuaaaaauaucuagcugaagaaaggaugacaggaacuga

SEQ ID NO: 4199373 - RNA, 60 nt, Human
ucaggagaaucagggcuguccuuugcugccagaagcagagggcuuguuccuuuuucuuga

SEQ ID NO: 4199374 - RNA, 63 nt, Human
ucaggagacuggcagugcccacuccuagggaggaaacuggguuacagcuagaaguacuuuugg

SEQ ID NO: 4199375 - RNA, 73 nt, Human
ucaggagcagcaugggugagaggcaguggaauguacuaaggagaaaacugccaaauucacauucuguaccuga

SEQ ID NO: 4199376 - RNA, 61 nt, Human
ucaggagccugaaagaggucuaacuaauuaaauacuaggauuucuugccccugcucccuga

SEQ ID NO: 4199377 - RNA, 76 nt, Human
ucaggaggaaaguuccacucaacuugcuauuucucaucuagcucggcaguguugagaggccuggcucuuuuccuga

SEQ ID NO: 4199378 - RNA, 60 nt, Human
ucaggagggcuaagacuguagcuuguuaucaggcauuucuuacucuuaguccaaacuuga

SEQ ID NO: 4199379 - RNA, 88 nt, Human
ucaggaggugggcagaugauaaaugcaugugcuuugucugccaucucaaagcuucaguuuucuauuguuaauuguuaccaccuucuga

SEQ ID NO: 4199380 - RNA, 88 nt, Human
ucaggauuaugcaaggacuuauuacaguguaaacaugcuugccauuuuggcugccugucaaacguaauacuauucuuagugaugcugg

SEQ ID NO: 4199381 - RNA, 55 nt, Human
ucaggcaggacaauuauuuaggacugaagcauugcaggauaauuauccuuccuga

SEQ ID NO: 4199382 - RNA, 69 nt, Human
ucaggcaggguuuacaauagcaauaauguaauucaaauaagcaauuauuguaauugaccuuggcgauga

SEQ ID NO: 4199383 - RNA, 60 nt, Human
ucaggcugggagacaaucacugugacuguugacaucuguggcuucaguuucccagucugg

SEQ ID NO: 4199384 - RNA, 58 nt, Human
ucaggcuucacuccuguccaagguuagcucugcuucugggucaggcugggaguccuga

SEQ ID NO: 4199385 - RNA, 57 nt, Human
ucagggagaggugagagccugugaaggcggcucuucacaugucucuaaucucaguga

SEQ ID NO: 4199386 - RNA, 69 nt, Human
ucagggagcuaggauccugaaggugggaagggagcagauguccaccagacacugggccuggcuucuaga

SEQ ID NO: 4199387 - RNA, 78 nt, Human
ucagggcagaauccaaagaauuuuuaagaggaugugaaaaaaaugacuagagagagcuuuccuuggauugugucuuga

SEQ ID NO: 4199388 - RNA, 64 nt, Human
ucaggggccucucuuuuaggguguaaauucacagcccccauauugugaacagagaggacucugg

SEQ ID NO: 4199389 - RNA, 99 nt, Human
ucagggguugcuccgucaucucugccugugugcaacuugcaguuuugcaguuuucugcagcagcugaggcgcuggcgugggaaggcggagcuccccugg

SEQ ID NO: 4199390 - RNA, 65 nt, Human
ucaggguaugugcguaauaagugacagacauuuuacgucguguuacaugugugcacacauucugg

SEQ ID NO: 4199391 - RNA, 100 nt, Human
ucagggucaucaugaaguugcuguguuucuaaguaaaggagcucccuugagaagagauagggaaguuugugagaaauaugucagcuuucguggccucuga

SEQ ID NO: 4199392 - RNA, 95 nt, Human
ucagggugucagcagggcacgauccuccuggaggcucuaagggagaguccaagccuucgucuuucuggcuucuggaggcugccuguguuccuuga

SEQ ID NO: 4199393 - RNA, 82 nt, Human
ucaggugaguguggggagcugccuuagaccggagguguggacuuuuccuucccuuuuaggaagaaggcauucccguauguga

SEQ ID NO: 4199394 - RNA, 64 nt, Human
ucaggugauggugggagaggagaagcaagaugugcucucaugccuucuucaccaguuuaccuga

SEQ ID NO: 4199395 - RNA, 55 nt, Human
ucagguguguuguauuuuaccagguuuuccaugaggaucaaguacgaucaccugg

SEQ ID NO: 4199396 - RNA, 59 nt, Human
ucaguaaauuaaaguugggccauucgucaucacugacaaauugccccauuuugaacugg

SEQ ID NO: 4199397 - RNA, 58 nt, Human
ucaguaacuucaugaccaagcacacagguguuuaucauucuggugcaugagauacuga

SEQ ID NO: 4199398 - RNA, 94 nt, Human
ucaguaauaagauuuugguucauuugaauguaaaugcugcagcugaguauccagaagcugcguuuauuuaaaucccuauccaagauauuacuga

SEQ ID NO: 4199399 - RNA, 61 nt, Human
ucaguaggucugacugggcccuaaagaacggcauuguuaacaagcccccagaugcuacuga

SEQ ID NO: 4199400 - RNA, 71 nt, Human
ucaguauacgugugcuguuguuuuugguuuuacuuaauaaguguuuagugugauacacauacguaaacuga

SEQ ID NO: 4199401 - RNA, 73 nt, Human
ucaguauccuuguucugauuuuucugggaacuagauguuacugggagaugacucagagcaggccaagcccuga

SEQ ID NO: 4199402 - RNA, 66 nt, Human
ucaguaugguagccauuagccccaugugacuuauugaauccuugaagcauggcuaaucuguacuga

SEQ ID NO: 4199403 - RNA, 74 nt, Human
ucaguaugugcuaacugucaugcacauguguuuauaaugcugagcauaugaugauacuuggucauccaugcugg

SEQ ID NO: 4199404 - RNA, 72 nt, Human
ucaguauuccuggaaauacaagcuucuagccaacaguuugcaaaucaaaguucuguguuuucggaagacuga

SEQ ID NO: 4199405 - RNA, 67 nt, Human
ucagucaauaaguaauaggcaucuaauuugcauuaagcacaauucuaggauuccacuuauugccugg

SEQ ID NO: 4199406 - RNA, 113 nt, Human
ucagucucagaagagggauuggagggggaacccuguuacacacagcagcgucaacuuaaaauugcaccuuagcagcucugugugucagggccuuccagcccuuaugaaacuga

SEQ ID NO: 4199407 - RNA, 75 nt, Human
ucagucuucuaagcauuggucuuaauacugcauguucuuugcaaaauauaaaguguuguacaaauguaugacuga

SEQ ID NO: 4199408 - RNA, 130 nt, Human
ucagucuugucagguaauggaggggggaguucccugauccugggacugaaugggugcuucagcauuagcugcgccuguagaaguccugugauagccgagcacccucccucagauggccuguugagauugg

SEQ ID NO: 4199409 - RNA, 55 nt, Human
ucagucuuucgaauucagccagccagccagaaggggcguguugaggaaaggguga

SEQ ID NO: 4199410 - RNA, 93 nt, Human
ucagugaaacaaggcuuugggaguaagaaguccuggguucaagugcuauggaugcuguggaugccuugccccauugccccugggcccaccuga

SEQ ID NO: 4199411 - RNA, 96 nt, Human
ucagugagauauucacuaauaguuugaauaaaagguuauuauuugaguauaacuuuuaaaauacacagacaauaugggaguaaaucaagagacuga

SEQ ID NO: 4199412 - RNA, 58 nt, Human
ucagugagcugaaguccuuugaagaggcuucuuuccucaaaggacuguagcucacuga

SEQ ID NO: 4199413 - RNA, 75 nt, Human
ucagugaggaaugccagccaucuaagcccuagugaagcugugggugaagccagggacugacacuuccuggacuga

SEQ ID NO: 4199414 - RNA, 80 nt, Human
ucagugagguuaaagugcaguucccaaggucacacagcugguagaaguugagaugugauuugaacugacugccucuaggg

SEQ ID NO: 4199415 - RNA, 63 nt, Human
ucagugauacaugauuaguggaauaaggcuuugccaaccauuucaaggugucuguaccacuga

SEQ ID NO: 4199416 - RNA, 126 nt, Human
ucagugcaucauuaguuaaaugaacaaauuaguuaaaacucuguauuugcuguggguuucaaaaauuaccuggacaguaauuagaguuacaaagaguucuaaaacaaaaguugaugagaauaauga

SEQ ID NO: 4199417 - RNA, 55 nt, Human
ucagugcauuguucauuguaggcacucgguuuacgaauugaauaauaguagcuga

SEQ ID NO: 4199418 - RNA, 74 nt, Human
ucagugccgccuggcacucccacuuccugcuccuguuugguuucaccccaguggugccggguggguuuugcuga

SEQ ID NO: 4199419 - RNA, 78 nt, Human
ucagugcugugaagucaagaaugcaauuugagcugugccgacaggaaacaaauugaucuuuuuggccuguauuccuga

SEQ ID NO: 4199420 - RNA, 115 nt, Human
ucaguggacucaauucuguuauuuuagaaaguucaaauuauagaagguuugagguggcgaggcacuuacgcaucaucuaguuuaacuuucuuucugcauggaugaguaaaacuga

SEQ ID NO: 4199421 - RNA, 65 nt, Human
ucaguggauuggaugagaucugcucacauuauggaggaugaucugcuucauucaaagucuacuga

SEQ ID NO: 4199422 - RNA, 67 nt, Human
ucaguggauuuuccuuuccaaguagaaaugcagugcaauucuaaauggaaagaaaauaccuaaauga

SEQ ID NO: 4199423 - RNA, 60 nt, Human
ucaguggcauuugguuagaaugucuggcugacugaggacaagauaaugaagugcaauuga

SEQ ID NO: 4199424 - RNA, 86 nt, Human
ucaguggccuugugcagcuagccauguggcuccuguggguguaugugcggcuuggcaggggcuguggcaugggagcaggggccugg

SEQ ID NO: 4199425 - RNA, 66 nt, Human
ucagugggaaaggcagaguuguuggaggcauaacccaccagugccuugaagucugccuuuuaauga

SEQ ID NO: 4199426 - RNA, 56 nt, Human
ucagugguguguauauuuuguuugacauuuuaagcagaagaaagccacaugacuga

SEQ ID NO: 4199427 - RNA, 57 nt, Human
ucagugucaggcgccccaaagcauuuauucugugccaggcccugugcuggaugcuga

SEQ ID NO: 4199428 - RNA, 68 nt, Human
ucagugugcagccccgugcagugagaaaacaaaugcccaaggcuucugaugauggcggcuggagcuga

SEQ ID NO: 4199429 - RNA, 59 nt, Human
ucagugugcuuauugauauagcuuaaaacacuuaauacaagcuggucuuaaguaacuga

SEQ ID NO: 4199430 - RNA, 63 nt, Human
ucaguguggaaaauccuuuggcacaagcucuuaccuuauagugcacaagagaauacacacugg

SEQ ID NO: 4199431 - RNA, 69 nt, Human
ucaguguuggagauaauugcacagagaccuguuucccuuuucuucuuauccauuuaucugcaacacuga

SEQ ID NO: 4199432 - RNA, 80 nt, Human
ucaguuaaaguucuuacagaaaauagauaacauuuaaaaauauuaagugauguuuggauuugcugagaucuuugaccuga

SEQ ID NO: 4199433 - RNA, 61 nt, Human
ucaguuacacauaaacauuaaaggggccugacuuagggcgcucuuugccucuguggacugg

SEQ ID NO: 4199434 - RNA, 94 nt, Human
ucaguuauagcucuguuuuuuaagugguguaacacauuuaguaauuuuaauuuugcagaauguagaucaucaucaaggaauagaauaaagcuga

SEQ ID NO: 4199435 - RNA, 64 nt, Human
ucaguuaugucagccgauauuugucaugcuaaugaguugugguaagcuuggcugauguuauugg

SEQ ID NO: 4199436 - RNA, 69 nt, Human
ucaauuuagaguucagcaugacuuugauauacaaagcugucaagggcauuaugagaacuauggauuaga

SEQ ID NO: 4199437 - RNA, 64 nt, Human
ucacuugaacccaggaagcagagccaaggucgcaccauugcacucuagucugggugacgaguga

SEQ ID NO: 4199438 - RNA, 78 nt, Human
ucacuugaacccaggaggcagagguugcagugagccaagaucauaccauugcacauuccagccugggugacaggguga

SEQ ID NO: 4199439 - RNA, 76 nt, Human
ucacuugaacccaggagguggaguucacagugaacgaagaucgugccacugcccuccagccugggugacagaguga

SEQ ID NO: 4199440 - RNA, 69 nt, Human
ucacuugaggcugagagguugagggugcaguugagcugagauugcaccacugcacuccagccugaguga

SEQ ID NO: 4199441 - RNA, 76 nt, Human
ucacuugagucugggagguugaggcugcagugagucgugaucacgccacugcacugcagccuggccaaccgaguga

SEQ ID NO: 4199442 - RNA, 58 nt, Human
ucacuuggguguugaguguggagacuauugcguguggagacuaaacugcaccuaauga

SEQ ID NO: 4199443 - RNA, 80 nt, Human
ucacuuguugauggauuuuugggucauugcaguuuuugauauuacuaauaaaacugcuauaaacauucauguacaaguga

SEQ ID NO: 4199444 - RNA, 74 nt, Human
ucacuuuacagcuuagugguauggaucaugacaacccaacagaagauauguccauccagaaccugugaauguga

SEQ ID NO: 4199445 - RNA, 116 nt, Human
ucacuuuggaauuuuacaaaagcugugauggucaggcccuaucuccaaagauucugauucaaugcauuuggaauggaaccuaguuauccacauguuguauaaaguuccaaaaguga

SEQ ID NO: 4199446 - RNA, 63 nt, Human
ucacuuuggauuauguaauuucuuucuauucauaaugagcagcucuuacaugaugccaaguga

SEQ ID NO: 4199447 - RNA, 129 nt, Human
ucacuuuucaagcccauggacuaucucccagugcuguucauuuuaauauucugcagaguacuuaagcauuacagaauauagaagcuggaagauacuuggcagucauuuagucccucauguucuagauga

SEQ ID NO: 4199448 - RNA, 90 nt, Human
ucacuuuuccagguagggcggauggugcuucuucucaacuggcccucugcaugcugcgagaaggacuacacaucuggccugguagagugg

SEQ ID NO: 4199449 - RNA, 130 nt, Human
ucacuuuuguuaaacugcuugucacacuuugucuuuguuuuuaagaugauagaucugucaaugugaaauguuccauauuacaguucuguuucuuuaggacaaaaaugaaauccaagcuauuucuaaagga

SEQ ID NO: 4199450 - RNA, 75 nt, Human
ucagaaaagcuaugguuuguaggcuauugggagccucucucacaccgucccuaaaccaucucugacuuucucuga

SEQ ID NO: 4199451 - RNA, 99 nt, Human
ucagaaaauguuuauugaauaugcucuaugugccaaacaauuguguuacggcugaauauaugaauguuuggcuagauagauggaugaaugaacaaauga

SEQ ID NO: 4199452 - RNA, 65 nt, Human
ucagaaagauguacuaagggcagacacagaauuccaacuggagucugcucccagacaugaucuga

SEQ ID NO: 4199453 - RNA, 89 nt, Human
ucagaaaguacuugagagcuaagguguccuggaggcccauucuccggaguggguucagguuggccugagcacuggcugguguguucuga

SEQ ID NO: 4199454 - RNA, 62 nt, Human
ucagaaaugucugcaaaccuaaguuguguuuagaaacaaagcuaugaggcaugcauuucuga

SEQ ID NO: 4199455 - RNA, 72 nt, Human
ucagaacagguuguacuaugucccccaaaucauacugucuuagagggacaaucuagauaaucugucuccuga

SEQ ID NO: 4199456 - RNA, 84 nt, Human
ucagaacuccagguucuuuggccuuuggacucugggacuuacaccaguggcucccagguucuugggccuugagccucagacuga

SEQ ID NO: 4199457 - RNA, 62 nt, Human
ucagaacuuaaagccgauugggccacagaaucagguaaaucagaucuugcauuaaguuguga

SEQ ID NO: 4199458 - RNA, 73 nt, Human
ucagaagaaaaaagagcuuuccacacuagucagcaacuguugguguuuaaguguucuuucauuuuucuucuga

SEQ ID NO: 4199459 - RNA, 90 nt, Human
ucagaagaccaggcagcugggcagacugcagugguuacuuguagacuuguaaacaacuucugggcuguccaaaacugccuaguuuuguga

SEQ ID NO: 4199460 - RNA, 66 nt, Human
ucagaaguaggagacauucuugguccuaaggcaagauugccugucccugaauaucucaacuucuga

SEQ ID NO: 4199461 - RNA, 105 nt, Human
ucagaagucgaauggcccuuggcaaugcucuuuaaccuauucugaagaaguucccuuuaaguuaugaaguagguuaagagcaguagaccaauauuuuguuucuga

SEQ ID NO: 4199462 - RNA, 68 nt, Human
ucagaauaaaacuuauuagaauuguguaccaucaccaaguaugaauucugcaauagguuuaguuuugg

SEQ ID NO: 4199463 - RNA, 76 nt, Human
ucagaaucccucugcagcugguuccugacaucgcaaacguuaucugcaauucuuggcaguuucggaaggaugauga

SEQ ID NO: 4199464 - RNA, 56 nt, Human
ucagaaucgguggggccaggaauccagauuuuuggcaggugccccaaugauucuga

SEQ ID NO: 4199465 - RNA, 55 nt, Human
ucagaaucuaaauaggcuccaggcgcuggugacuuuuaaagcucugugauucuga

SEQ ID NO: 4199466 - RNA, 79 nt, Human
ucagaaucugcauuuucaugaguucccaggugauuugugugcacauucaaguaccagaagcacugaacucacagacuga

SEQ ID NO: 4199467 - RNA, 55 nt, Human
ucagaauggcccauaaauagucccuauuugggagcuuuuggaacugcuauuuuga

SEQ ID NO: 4199468 - RNA, 88 nt, Human
ucagaauuagaugucuauacugaugggauacuauuauaugauaaacaugaaguuuaauucggugaguaaaauauagauuaucuaauga

SEQ ID NO: 4199469 - RNA, 64 nt, Human
ucagaauucagagggaguggggugaggcagugggaggcaaugaaaauucccucuggauucuaga

SEQ ID NO: 4199470 - RNA, 59 nt, Human
ucagacaaguaaaauaauguaaagggcuacaggagccacaccuuacuuacuuguuguga

SEQ ID NO: 4199471 - RNA, 61 nt, Human
ucagacagggagucagaaaauagaacuuguauguuaauuuuuuauuguuuuccuguacuga

SEQ ID NO: 4199472 - RNA, 59 nt, Human
ucagaccucuugcacccuggcucuugcccaguggcccagagugucagcaagagguuugg

SEQ ID NO: 4199473 - RNA, 71 nt, Human
ucagacuugccuuuuuauaaaaaucacuccaguuacaguguggagaauggauuagagaagggcaaggcuga

SEQ ID NO: 4199474 - RNA, 58 nt, Human
ucagagaaauaauugcugaguuccuucuauguuuaaggaacugggcuaguuucuguga

SEQ ID NO: 4199475 - RNA, 55 nt, Human
ucagagaagcuuaagcuguaaucaaacugcuauuacaguagcugagguucucagg

SEQ ID NO: 4199476 - RNA, 75 nt, Human
ucagagacuccacauguauuaaaguagauaucagaagacauauugaauuucacuuugaugacauuguagcuuuga

SEQ ID NO: 4199477 - RNA, 55 nt, Human
ucagagaugcagugccaccuacagguccggaggcccccaggcgcugggucucugg

SEQ ID NO: 4199478 - RNA, 65 nt, Human
ucagagcuggcacagaaggaucuuagcacauauuugcugagugaaugcaaucccuuucagucuga

SEQ ID NO: 4199479 - RNA, 86 nt, Human
ucagaggacagcagcuaaauaacugacuggcaggguagauuuaugcaauucucaugggguuauuuguugaaggacuguccugcugg

SEQ ID NO: 4199480 - RNA, 58 nt, Human
ucagaggcuucugcucaccucacacuuucuugauacuucugagcagaggcucaacugg

SEQ ID NO: 4199481 - RNA, 76 nt, Human
ucagagggacuugcaggggagacugcguuuccucuaagucaaauuaguggggauguuuucacuuguaucccuauga

SEQ ID NO: 4199482 - RNA, 63 nt, Human
ucagaggggagaauuuggugugcugcauuauaauagccuguagauuucucuuucccuggcuga

SEQ ID NO: 4199483 - RNA, 65 nt, Human
ucagaggucacacagcaaguuugcggcagggccagggcugaaacuuaguguuuguggccuucuga

SEQ ID NO: 4199484 - RNA, 73 nt, Human
ucagagguggccagagucaagagccagguuucauuauaauucucgaguggucauggauagcuggagccuuuga

SEQ ID NO: 4199485 - RNA, 56 nt, Human
ucagaguaaaccugucaucaagaagccugcgugggaugucuaacugguuugccuga

SEQ ID NO: 4199486 - RNA, 72 nt, Human
ucagagugaugggaugggguggagaaaagaaacuucaacagacugaucucucccucugccuuucuagucuga

SEQ ID NO: 4199487 - RNA, 65 nt, Human
ucagaguggugcaagggcaguguugagaugcuuuaagcagcagccugagcuuuagcacuauuuga

SEQ ID NO: 4199488 - RNA, 70 nt, Human
ucagaguugcuuauuauaauuucuugauuguuugauaaaagguacaucccaagacauaugaguacucugg

SEQ ID NO: 4199489 - RNA, 68 nt, Human
ucagaguugucugguccuaaagcuaccuugugucuuauagguggcagcugguaugcagacagaacuga

SEQ ID NO: 4199490 - RNA, 80 nt, Human
ucagauaaagcacauucuuucacaguucugaaacccuuuguuuuaggcuuugcaagagugaaaaauauuguucuaucuga

SEQ ID NO: 4199491 - RNA, 75 nt, Human
ucagauaaucgggucccaggucuggaaaagcagccuuuuccccacguuucuuuccccaccuaggaccuccucuga

SEQ ID NO: 4199492 - RNA, 60 nt, Human
ucagaucagugcugucccgacaacugaggccaaugacauggcacguggcaguagaucuga

SEQ ID NO: 4199493 - RNA, 85 nt, Human
ucagaucguagggaacaaaagagcuuggugcacagugguuaauaucgucaauguaucauacaccaggcucugucuaaucgacuga

SEQ ID NO: 4199494 - RNA, 69 nt, Human
ucagaucuuaggugugaaguguguuuagacauuaaaaaaucagaacacugaggacacugagaauucuga

SEQ ID NO: 4199495 - RNA, 68 nt, Human
ucagaucuuucaucuauguauuuagucaaugaaaacauguugacuacauacuguguguaaagaauugg

SEQ ID NO: 4199496 - RNA, 75 nt, Human
ucagaugauagaugcuaaggucccugaauguguggagcaaagccaacuacucacccuuaguguacuaucauguga

SEQ ID NO: 4199497 - RNA, 74 nt, Human
ucagauguuucacuguaauggaauuuucuuuacaucagugaaauugauuaccagguagugggaugaacaucuga

SEQ ID NO: 4199498 - RNA, 68 nt, Human
ucagauuaaugcagagcauuguuuuuggcaaguuguugaaaacagcuacuucuguauaaugaugcuga

SEQ ID NO: 4199499 - RNA, 98 nt, Human
ucagauucaaccagggagcuaccacaugcuacucaaugcagggcaggauaugaguccucccaucccugcaagagagcaaagggguuaauugguuguga

SEQ ID NO: 4199500 - RNA, 66 nt, Human
ucagauucuagaucagugcuguccaauagaacacuugaaguguggccagugcaacugaagaacuga

SEQ ID NO: 4199501 - RNA, 126 nt, Human
ucagauuggauuaggacccacccuacaagcuucauuuuaauguagucaccucuuuaaauguccugucuucaaauacagucacauucugggguacuggggguuuagggcgucaauauuugaaucuga

SEQ ID NO: 4199502 - RNA, 62 nt, Human
ucagauuuccuguugaagaaguugauaaaaacauuucauuuuucuaaacaaagggaguuugg

SEQ ID NO: 4199503 - RNA, 61 nt, Human
ucagauuuuauuuuccuguuaccaaaguuaaacuuuguccugcaaaggaaauaugaucugg

SEQ ID NO: 4199504 - RNA, 57 nt, Human
ucagauuuuccagccuuucucuccuagcaaaggccagauaaggcugugauagucuga

SEQ ID NO: 4199505 - RNA, 56 nt, Human
ucagcaaaacuguaccuuuguguuacuggcagaaaaggcuaucaaaguuuugcuga

SEQ ID NO: 4199506 - RNA, 58 nt, Human
ucagcaagcagggggauguucagggggcccaagucucccucccucuggggguuguuga

SEQ ID NO: 4199507 - RNA, 84 nt, Human
ucagcaaguugugaaugacagacuucacuuucucaggcauauuugcauauugaaaaagaaguuuguaauucaaauaacuuuuga

SEQ ID NO: 4199508 - RNA, 78 nt, Human
ucagcacccugaggcacaggccacguauacagcaggugguccuuggaugcuuguaggccuggccucagaggagcaugg

SEQ ID NO: 4199509 - RNA, 118 nt, Human
ucagcaccugcaaggggaugcugggugagauccugucugcauucgaguucauggaugcugugugcaugcagcuggucgggcgccaucuccaccuggccagcccggugcaagguacuga

SEQ ID NO: 4199510 - RNA, 68 nt, Human
ucagcacucacaagaguaaguucaugccucuguguauacaguuagagcugaauaugcuuuuguucuga

SEQ ID NO: 4199511 - RNA, 63 nt, Human
ucagcacucgcuaccuaguaaauugacugaugaugcaucaaagcuaguuagaagaguaguuga

SEQ ID NO: 4199512 - RNA, 55 nt, Human
uccagcuccacagccucccuguccuuaauaaaugagcaacagaggcaggagugga

SEQ ID NO: 4199513 - RNA, 76 nt, Human
uccagcugaaggcaauuuggaagaggcagaugcagaaaagcucucuaccuucccucuauuugccuaaaaagcagga

SEQ ID NO: 4199514 - RNA, 85 nt, Human
uccaggcacuuucucuaagaguuauaugaauugcucccucuaaacuggggugagaguucuaaacacuugaggaaccaugcuuuga

SEQ ID NO: 4199515 - RNA, 61 nt, Human
uccaggcaguuuuccagguuguacuauucuucggaauaagcacaacaaacuugcuuaagga

SEQ ID NO: 4199516 - RNA, 67 nt, Human
uccaggcauugccauuccuccagagagaauucuauagcuaugucucugaaugucaacagucccugga

SEQ ID NO: 4199517 - RNA, 89 nt, Human
uccaggcuagcgugagaggcccugguaggucagagugucugguugccuaagcuuuuguacaucaguggccuuggacacguuuuccugga

SEQ ID NO: 4199518 - RNA, 101 nt, Human
uccaggcugucaccugcuuuguaguguuugcugauuucugugacccaucuguugguagguuucaagccaccagugagauaccacagagcaaacagcuggga

SEQ ID NO: 4199519 - RNA, 62 nt, Human
uccaggcuuauacuugacauuugucucuuuuaaauugaaaacaaauguuacauaaguuugga

SEQ ID NO: 4199520 - RNA, 58 nt, Human
uccagggaagagcagaggcuacaacacagaggugugagagagccugguuuuccuagga

SEQ ID NO: 4199521 - RNA, 56 nt, Human
uccagggacacagaguccuucuaucuuauaacuuuagcauccucuguggcccugga

SEQ ID NO: 4199522 - RNA, 56 nt, Human
uccagggccacagaggaugcuaaaguuauaagauagaaggacucugugucccugga

SEQ ID NO: 4199523 - RNA, 59 nt, Human
uccagggcuguuacuuuacauauuuguugagacccuucaguguucuguaacagccugga

SEQ ID NO: 4199524 - RNA, 95 nt, Human
uccagguaccuucuccaauccuaaagcagacagcagguugaauaaaaccaauacacaaccuauuuucuaggcaggaggggaaaaggcccuuagga

SEQ ID NO: 4199525 - RNA, 61 nt, Human
uccaggucucagaccacccucuuuggcccagggugggucaaaccuacugucugagucugga

SEQ ID NO: 4199526 - RNA, 59 nt, Human
uccaggucuggccugcuaggcauguauuugcucgaggccaagagagagccaggccagga

SEQ ID NO: 4199527 - RNA, 71 nt, Human
uccaggugccuuuguuuucaucucacuuucuggcauaggaugcucuaaacuuguaaacaagcauaucugga

SEQ ID NO: 4199528 - RNA, 55 nt, Human
uccagguggcuuuccugggggaaugccugguaauuuucccagaggaaugccugga

SEQ ID NO: 4199529 - RNA, 74 nt, Human
uccagguggguugugucaggcugcagagggagcggccugggccuggcccucugaaccugguagcagaaucugga

SEQ ID NO: 4199530 - RNA, 62 nt, Human
uccagguuauggaugguguuauagucaguuugggaugcuauaacaaaguaccauagacugga

SEQ ID NO: 4199531 - RNA, 74 nt, Human
uccagguucaagugauucuccucccucagcuacccaaguagcuggcauuacaggagcaugccaccaugccugga

SEQ ID NO: 4199532 - RNA, 55 nt, Human
uccaguacugaagcuccuucaaugccuaagugauacuagcuacucagugcuagga

SEQ ID NO: 4199533 - RNA, 65 nt, Human
uccaguaguuggacaaauagauucggucucacaagaggggaauaauuuguguauucaacuaggga

SEQ ID NO: 4199534 - RNA, 64 nt, Human
uccagucaggcugaauucaaggcccaggcccccgugucggaggccuuccucagcacugucuggg

SEQ ID NO: 4199535 - RNA, 72 nt, Human
uccaguccauggccucagucuuaggggguagcuuucuucuccgcagagacucuuggggacucuggaacagga

SEQ ID NO: 4199536 - RNA, 67 nt, Human
uccagucccucaguagugcacaguggcacuugacacagccagaccugcaaggcugagagggcacaga

SEQ ID NO: 4199537 - RNA, 73 nt, Human
uccagucuccaagaaagguuacauucugagguccuggggguuagaacuucagcaucuuuuucuugggggcgga

SEQ ID NO: 4199538 - RNA, 55 nt, Human
uccagucuugucuccuaaccacccaguggguuucugcuaggaaauagggcuguga

SEQ ID NO: 4199539 - RNA, 64 nt, Human
uccaguucuguggcagcgaaggagaggagguaaaagauccuuacgugacugccucaggggugga

SEQ ID NO: 4199540 - RNA, 64 nt, Human
uccaguugcugcuucucucuagagaccuuuuaugcuuguuuaguucucuaugaagucaacagga

SEQ ID NO: 4199541 - RNA, 69 nt, Human
uccaguuuugaagggcacgacaauaguucagacauuugucaguagcuaugaagccacuuuuaacaugga

SEQ ID NO: 4199542 - RNA, 72 nt, Human
uccauaauugucucaucuucauugucucccauccugugacagagcugggugggaggugggaaggagacagga

SEQ ID NO: 4199543 - RNA, 73 nt, Human
uccauacagguggcauaagaacacuaaagaugagaguuuggggguggauuuaugcacacaaacuguguuagga

SEQ ID NO: 4199544 - RNA, 55 nt, Human
uccauacauauccaaagagaaguuccucauucuuuucugcauauguauguaugga

SEQ ID NO: 4199545 - RNA, 58 nt, Human
uccauagaaacuagauugauagcggaauauuuauuccuuuguccugugguaucuugga

SEQ ID NO: 4199546 - RNA, 86 nt, Human
uccauagcucaucuuucuccaggcagugcaagaugaccaccagcagugccaagcuucuauuuugccugccuagaaaucucugugga

SEQ ID NO: 4199547 - RNA, 97 nt, Human
uccauaguacauguuaccuaaugucuuucucauaacagauaugguuuacugaguauuuguuauguagaagacacuggaccaaguagacaacuuugga

SEQ ID NO: 4199548 - RNA, 86 nt, Human
uccauaugaucuuaggaaaguuggcugauuucucugacguuuucuucaucuacacguauaugaaaaaguuaauuucugucauuggg

SEQ ID NO: 4199549 - RNA, 56 nt, Human
uccauauuuuagauaaaguuauguagacaaucuauuggcucuguucaauauaugga

SEQ ID NO: 4199550 - RNA, 57 nt, Human
uccaucauuuguccuggaaagacagccagccgggcgguacccagguggaaucgugga

SEQ ID NO: 4199551 - RNA, 71 nt, Human
uccauccauuuguuucccuugggaaacagcagcuccucugagguuucccauaucuagggagaggaggugga

SEQ ID NO: 4199552 - RNA, 55 nt, Human
uccaucuccagguugacuucagucaauaauccuauugucuuaaggcuggagugga

SEQ ID NO: 4199553 - RNA, 92 nt, Human
uccaucugccucacauauaagaaggacguugggaccaggcgugguggcuuacgccuguaaucccagcacuuuggaaggcugaggcggaugga

SEQ ID NO: 4199554 - RNA, 101 nt, Human
uccaucugucugucugguauuccuggagcuuggucacgcugcgggagcucuggcuugcagcuggcagggcccgggguugaagggacagcucccagcaugga

SEQ ID NO: 4199555 - RNA, 89 nt, Human
uccaucuguuugucuuaaauuaggacucuaguucuggaaucaagcuugagacucugagaacuuagggccuaauuuuacuuuacugagga

SEQ ID NO: 4199556 - RNA, 95 nt, Human
uccaucuuauccuacaaucaggcagcaaguauuuacugaguaaugauugccugccagcagcaugcaguaaguacccugugauguagagagauaga

SEQ ID NO: 4199557 - RNA, 77 nt, Human
uccaucuuuuagauguuuuaacucuugguuagaaugauauuauauuuuaccuagaggcaaaauguguagcagagaga

SEQ ID NO: 4199558 - RNA, 82 nt, Human
uccaugaaagcaauauuucagcuagcagguggugaaguaaauuuuuagagcaaguaccugucagcuccaguauuccuuugga

SEQ ID NO: 4199559 - RNA, 60 nt, Human
uccaugcccccaucucuguuggcuccucagggcucacuccuggagguggugggcaaagga

SEQ ID NO: 4199560 - RNA, 62 nt, Human
uccaugcugaguauuuguuugaauaacuuaucaguucauuggggcauauacuuaagagugga

SEQ ID NO: 4199561 - RNA, 95 nt, Human
uccaugcuguauauacugccugucuaccagucacuuagcggccaucuaggcuguuagauggacuguagcagcaacauagugcuuauggucaagga

SEQ ID NO: 4199562 - RNA, 84 nt, Human
uccauggguacauaaugagcuaguuaaguuuaggugucugugagagauguccagcaagugguugauaauauguauuagcauuga

SEQ ID NO: 4199563 - RNA, 71 nt, Human
uccauggugcggguggcagcucaucccuucucaaacuuuuugaggaagcuccccaagccugcccuagugga

SEQ ID NO: 4199564 - RNA, 64 nt, Human
uccaugguuagaaauagcggacccucggggaaggggucuccagcccacucuagauauucgugga

SEQ ID NO: 4199565 - RNA, 89 nt, Human
uccauguaagccagauuugggugugugcacugguuugguuuuguuuacuuuggcagcugcuacaauucacaucuggauauauauacggg

SEQ ID NO: 4199566 - RNA, 69 nt, Human
uccaugucuguaagaggccugcugcaugaucuuuugagacagaauggcagaauuuuaaagacagaugga

SEQ ID NO: 4199567 - RNA, 115 nt, Human
uccaugucuucagauccagguccuugcccaugucuggcagagacuccaccugagagcgucucggguaggcucugcaggcuggguuccuggcgcccugcucuguacucuuuaugga

SEQ ID NO: 4199568 - RNA, 55 nt, Human
uccaugucuucaugugucuaacuuccaaggagggggcuaacagcacagacaugga

SEQ ID NO: 4199569 - RNA, 60 nt, Human
uccauguggccagacacuggcauaagaggcugaaaugccccagugguuggaaacuauggg

SEQ ID NO: 4199570 - RNA, 64 nt, Human
uccauguggcuuucaugauuaagcagccacucuggccuguuuaguauuuaagguuuuagcagga

SEQ ID NO: 4199571 - RNA, 56 nt, Human
uccauguuuuguguguguuuccucccucuaggauggaagcacugugguggcaugga

SEQ ID NO: 4199572 - RNA, 102 nt, Human
uccauuaugucacaauguucccuauuuuauuuagguuuaguuguugugcaacugcugauuauugaaguagaggguggaggacauauguauuucauauaagga

SEQ ID NO: 4199573 - RNA, 80 nt, Human
uccauucuucacugacccaccaguuugcaacccuggucuaagguauccaggguuugcagggaaaucagugaggaugagga

SEQ ID NO: 4199574 - RNA, 61 nt, Human
uccauugauagauauuuugguugugucuacuuuuuauuauuaaucaaaauauuucugugga

SEQ ID NO: 4199575 - RNA, 75 nt, Human
uccauugcucucuccagaagacccauccucaugcucugcucuucccugggcaugugucuuuauggagccacagga

SEQ ID NO: 4199576 - RNA, 88 nt, Human
uccauuucgaagugauggcaguuuuagaacuuuucaaugcacuuuuguggaggcuccugaagaguuuaaaaagccaucaagugaagga

SEQ ID NO: 4199577 - RNA, 114 nt, Human
uccauuuuauaaguuaaagaaucauagcaguaaaaacuuuauagccauuucacucuaauuauuagagugagaaccucgaagauuuugcccuuugaaaaugacuuguuauuuggg

SEQ ID NO: 4199578 - RNA, 68 nt, Human
uccauuuucucuuccggaggugugcacuaaaauuuguacucuuccucuaugggaacuuugacagugga

SEQ ID NO: 4199579 - RNA, 69 nt, Human
uccauuuugucauaucacacaauuuugucagguauucaggcaaggauuggcugauugacaucagcuggg

SEQ ID NO: 4199580 - RNA, 63 nt, Human
ucccaaagggugucagcagcaagcuccaucgacuugccuacauugcccaccccaagcuuggga

SEQ ID NO: 4199581 - RNA, 70 nt, Human
uacaaaaaacaccugugugaguauaugugcacacgugcauucuuuugcauacacacaaucagguuuugua

SEQ ID NO: 4199582 - RNA, 68 nt, Human
uacaaaaagucgggagacuagaagcccuguugucuccucuagcaggcuucugggauucccuuggugug

SEQ ID NO: 4199583 - RNA, 130 nt, Human
uacaaacauaugccaaaagcagagcacuuuucuaacauaguuuaagauugcuaggagaugaagaggcuacaugucuguaauuauuuuaggggggugcuuuauaagaacuguuugcuuaaggaugacugua

SEQ ID NO: 4199584 - RNA, 61 nt, Human
uacaaagaggcagcuccauuuuauuuuauuagccucccuuagauguggcagucuuuuugug

SEQ ID NO: 4199585 - RNA, 55 nt, Human
uacaaagagguaauugcauauagauuagagaaguccaguguauucccuuuuugua

SEQ ID NO: 4199586 - RNA, 103 nt, Human
uacaaauacagagucuagcacaguaugguaucagauugcuauucaauaaauaauggauauuauagggcuaauauuguugcugagguccuguauucuaacugug

SEQ ID NO: 4199587 - RNA, 90 nt, Human
uacaaauauaaacacaauguguacaccugucuuuacacauacauacaaguguaugugaaugaaaugugugugcgugugugugugugugua

SEQ ID NO: 4199588 - RNA, 129 nt, Human
uaccaggaacccuaccuccccaccucugacccagcucuccagugcccaggagaauucccugcuuuguaaaaugaauucuccuggacacuggagaucugggucagagcuggagagauaggguuccuggca

SEQ ID NO: 4199589 - RNA, 56 nt, Human
uaccaggcagcugcacagaggccuaagugcacaggaaagguggaggugcucuggua

SEQ ID NO: 4199590 - RNA, 55 nt, Human
uaccagggaccgccacacugcaauuaucauugcagcccggguugguuugugugug

SEQ ID NO: 4199591 - RNA, 57 nt, Human
uaccaguugauguuuuaaauaguauuccuuugaauccuaugccauugucaucuggua

SEQ ID NO: 4199592 - RNA, 56 nt, Human
uaccauaugaaacaugagaaauggagagcuauaguuuuacccugauguuucuggua

SEQ ID NO: 4199593 - RNA, 55 nt, Human
uaccaucacauaugcuguauuggcuauuuucugugaguacaauguguuguuggua

SEQ ID NO: 4199594 - RNA, 130 nt, Human
uaccaucaccuggagaacuuaaaaaaauaaagacugcugccugggccucacccuagaccaauuagaucagaauuuccaggaguugaggucugaacaucauuaauuuuuuaaagcuccccagcggauuuua

SEQ ID NO: 4199595 - RNA, 63 nt, Human
uaccauggcucagcugacucggcuucucccaguaaaggaagaaugggcuggcugagcccggug

SEQ ID NO: 4199596 - RNA, 65 nt, Human
uaccauggggaagagccagugagcugaggugucaaaucucaacugaucuauuuccuaacugugug

SEQ ID NO: 4199597 - RNA, 68 nt, Human
uaccaugucaagcgagacauguuuaaugacaaguggaucuuguuuugacaucuggcuagauuuuggua

SEQ ID NO: 4199598 - RNA, 68 nt, Human
uaccaugugcagccacagaggagggaugcagguucaccccuaaguguccaaauuguggugauaaggua

SEQ ID NO: 4199599 - RNA, 94 nt, Human
uaccauuaugaauacauuuuaccuuaaagucuauauugccuguuauuaccauagauacacuaggguuuugggguggggugacuuuugcauggua

SEQ ID NO: 4199600 - RNA, 98 nt, Human
uaccauuccucaugaguuaauuauuagguuggugcaaaaguauuugcgguuuuugcuaauuacuucugcaccaaccuuaauaauuuacaugauaggua

SEQ ID NO: 4199601 - RNA, 72 nt, Human
uaccauuugagagagaacauaaucuuucaucugauuuucuuuuaggaugugugcuuuuuuucaaauaaggua

SEQ ID NO: 4199602 - RNA, 91 nt, Human
uacccacaaaauauccaauuagagaagcuucuuccauuuuagagagacugcuugguaaauggagacuucaaaauggauuugugugcaggua

SEQ ID NO: 4199603 - RNA, 57 nt, Human
uacccagcaaucccuagagguucugauucaauugcuuugugugguggauacugggua

SEQ ID NO: 4199604 - RNA, 58 nt, Human
uacccaggacuuggcaaccucauuugcuaaaagucaaucaugaggacagugcugggua

SEQ ID NO: 4199605 - RNA, 58 nt, Human
uaccccggcuuucaguuggguuugaccaaugauaaacaccagcagaagacugagggug

SEQ ID NO: 4199606 - RNA, 72 nt, Human
uacccuuagguagcugacguuuuagguguuaaaucgaagguuauugaagcauuugcagaugugccuugggug

SEQ ID NO: 4199607 - RNA, 67 nt, Human
uacccuugauagcaucccucaauaacauuacaucauaagaauauucuggguuugcuguacaaaggug

SEQ ID NO: 4199608 - RNA, 73 nt, Human
uaccgaagugugcucaguugaguguuuauacagucauaguuuaaacugauauacacuccacugauacagggua

SEQ ID NO: 4199609 - RNA, 61 nt, Human
uaccgauuucauuaugcucaugcuuaauuuuguuagcaucaagacgaugugaaaucgagua

SEQ ID NO: 4199610 - RNA, 114 nt, Human
uaccuaaaaacaaggauugcuuagugaaaguguuugcauauuuuuaaguuuacagagcuccucagacuuuaaugugcaaaugaaacacuuggagaucuugucaaaaugcaggug

SEQ ID NO: 4199611 - RNA, 68 nt, Human
uaccuccagaaauuuggaugcagcaagucugaaaggaucucuguuuuguuacaaguacucuggaugug

SEQ ID NO: 4199612 - RNA, 87 nt, Human
uaccucugucagcuuccaagguguucugcugguuuucuaaagaaagaaaauuaugcaauuguuuuugguacaguugacuauauggua

SEQ ID NO: 4199613 - RNA, 86 nt, Human
uaccugagagaggacuacaaauacuguuuuauuccaugaucaaucagcugaguguagaaagaaauauauuaccucuuccucaggua

SEQ ID NO: 4199614 - RNA, 85 nt, Human
uaccugcagaauaucuuguauuaguuucccaugcuccauuuuuuucccauggugcugugauaaaugcagaugucaccugcaugua

SEQ ID NO: 4199615 - RNA, 64 nt, Human
uaccugcgaaagagagcacuugugaaauacuaaaguaccugcagcuuuaagcuuucaucaggua

SEQ ID NO: 4199616 - RNA, 61 nt, Human
uaccugcugugugacgggauguuagagaacccaacucuguaucuauuuuaacagcauggug

SEQ ID NO: 4199617 - RNA, 58 nt, Human
uaccugcuuuuuaggcauauggggauuuaaugagcuaauaggugcagagagcauggug

SEQ ID NO: 4199618 - RNA, 60 nt, Human
uaccuggauguuuagauuggcagucauuguuaagacugcaguguuuguggaauucaggug

SEQ ID NO: 4199619 - RNA, 60 nt, Human
uaccuggugcuuacugaaaccauucuaguuugagagcagauggaccauaaacaccaggua

SEQ ID NO: 4199620 - RNA, 71 nt, Human
uaccugguuagaggcuucuugcuugguccucuguaccuauauauagauuaagcagagcccugaacuaggug

SEQ ID NO: 4199621 - RNA, 99 nt, Human
uaccugucccuucuugcaggaauucagccuugggauguggagcugucuccaugcagugcuggagcugauugauucccaacagcaagaucgauacuggug

SEQ ID NO: 4199622 - RNA, 73 nt, Human
uaccuguggaaauguuugcuucaaggucauccuuagauaacaauaugaaguagauaucacuucucucugggua

SEQ ID NO: 4199623 - RNA, 62 nt, Human
uaccuuacaagcuguauguuaccacugucaucugcuugauuugcaagcauccagcuuaggug

SEQ ID NO: 4199624 - RNA, 77 nt, Human
uaccuugaaacaagacagguuacuggcagauggcuuaagaauggaaaauuugccuuggugauuuguaaaaugaggua

SEQ ID NO: 4199625 - RNA, 69 nt, Human
uaccuuggagcuggaggccaaugagacucccuaaucuacaacucaggcugagucucucagcuucaggua

SEQ ID NO: 4199626 - RNA, 82 nt, Human
uaccuuggaucaaagagagaaagccccugcaucccuccaucagauugauagugugagacacuuuuucucuugauuaugggua

SEQ ID NO: 4199627 - RNA, 60 nt, Human
uaccuugugguuuucugcaugcagguuuaagccugcauuuacacuucuaaccacaaggug

SEQ ID NO: 4199628 - RNA, 78 nt, Human
uaccuuugaaaagaaccaucgccuuaugccauaaucuuccucuugcuauuuggcugugguuauuuuuuaggauuggua

SEQ ID NO: 4199629 - RNA, 67 nt, Human
uaccuuugggucaauguucugauucuuuugcagcuucugcucacaagacugagcuugcuugauggua

SEQ ID NO: 4199630 - RNA, 69 nt, Human
uacgaaauacagaacucucaguuguauauaucaaauaauauuugucuguagcugaauucugugaacgua

SEQ ID NO: 4199631 - RNA, 130 nt, Human
uacgcaaagauuuacaaucauuccagguaugcagaguaucaauaauagaggagcuacccagaaauguguuguuucucauugaauauucagugcgugauaugaagauuuaucuuguaaauaucacugggua

SEQ ID NO: 4199632 - RNA, 90 nt, Human
uacgcugggcaggacgacaaacacgagacgccacuguggaaugagcaacuucggagcacggggugacuugcuugggaccgugcccacgug

SEQ ID NO: 4199633 - RNA, 76 nt, Human
uacggaagcccuggcaugcaugucccuggcuuugccauauacaggcaugcugggacugcagcuaagggcaucugug

SEQ ID NO: 4199634 - RNA, 65 nt, Human
uacggguccuggucacauauguucauuuugagaaaaauacauugaacugugcccuaugacuugua

SEQ ID NO: 4199635 - RNA, 60 nt, Human
uacguaguuguuauuacugcauauggucccugggccagugcacaauggaacaacucagug

SEQ ID NO: 4199636 - RNA, 80 nt, Human
uacgucugaaaauaaagaauggaugagaucgugagggucccuugacgauuaggcauuuauucuuuauuugaaaugcagug

SEQ ID NO: 4199637 - RNA, 89 nt, Human
uacgugaauggcccagcagcugguuauaccugugguuucugcuaauuagccugagguugugcuggcugccuccuugggcuuucagagua

SEQ ID NO: 4199638 - RNA, 72 nt, Human
uacuaaauuuucagguuuuacucuccuauuguagaaaguagccugccugggggacuaaggccaaaucuagug

SEQ ID NO: 4199639 - RNA, 71 nt, Human
uacuaaccacaacacuaaaugcugguggggguggagcaacauaaacucucauuuauuguugugggaaugua

SEQ ID NO: 4199640 - RNA, 60 nt, Human
ucaguugcuggaugugcagcucucagaaaggcagaccuugggaguacacucugcagcuga

SEQ ID NO: 4199641 - RNA, 80 nt, Human
ucaguugggcugugcuggugccuccagcugcuucuccugauaggaaggagacacagaagguggcucuaacucugaacugg

SEQ ID NO: 4199642 - RNA, 77 nt, Human
ucaguuuaaccgcauuagugcucuuuuaagcuugaaagagguaguuugagagaguaauugagugguaaacuuacuga

SEQ ID NO: 4199643 - RNA, 60 nt, Human
ucaguuuaggacaguuuucuguaaucuagcuauugcaaauaacuguacugaauauucuga

SEQ ID NO: 4199644 - RNA, 61 nt, Human
ucaguuucagaaucaaaacaucaagcugucacuuuagaaugaacaggauuugugaagcuga

SEQ ID NO: 4199645 - RNA, 73 nt, Human
ucaguuuccucaucuguaaaaugaagaugauaauaauaucugccucauuugagagacugaggacaaaacauga

SEQ ID NO: 4199646 - RNA, 94 nt, Human
ucaguuucuauuugcgaggacuguguaggacaugcauuccagaagggaaaaucaauaaccccugucucugccagcuagcagaauuuggaauuga

SEQ ID NO: 4199647 - RNA, 81 nt, Human
ucaguuugucucugaacaaacugcauucuucacuuuuacuccaguagacagucgaggucagcaguuuuucagccguguuga

SEQ ID NO: 4199648 - RNA, 100 nt, Human
ucaguuuuucauguuccaugcauuggucagggucuuagggagugauucauucuagcagaacucccuggauuuuaaggcagauguuccauuuauuaauuga

SEQ ID NO: 4199649 - RNA, 57 nt, Human
ucauaaaaugcuccugauauugcaggaaacucaguagucuggcagggucuuuaguga

SEQ ID NO: 4199650 - RNA, 62 nt, Human
ucauaaacugucugcaaaacucauacucaccaccuggguguuguguggaaagcaggcuauga

SEQ ID NO: 4199651 - RNA, 62 nt, Human
ucauaaaugcaacaggcugcuuuuuuuuaaaucaucacuagaggcaguugagcauguuauga

SEQ ID NO: 4199652 - RNA, 74 nt, Human
ucauaaggcccaaaauucagagacuaauuguaaauucacauaaucagauuucuagcguuuggccaaucuuguga

SEQ ID NO: 4199653 - RNA, 63 nt, Human
ucauaagggacuuggcuggcaaucaguugaagauacuauuccuuuggcagcaguuccaaguga

SEQ ID NO: 4199654 - RNA, 130 nt, Human
ucauaauauggcuuaauaaaagccuaaaucaagaaacuggugcucccuccuuccucaaggaugcaauccuuagacaaagagugggcuuagauuugguuguaguuuacauuucagucgugguuauuuauga

SEQ ID NO: 4199655 - RNA, 91 nt, Human
ucauaauugccacuuuuucauauaugguguucagaaucaugauaauuauaaagcugaugauggaggccgugauggacguggcugucugugg

SEQ ID NO: 4199656 - RNA, 60 nt, Human
ucauaauuguauacauuuaugggauacaaugugauguuuugauauauguauacaaugugg

SEQ ID NO: 4199657 - RNA, 62 nt, Human
ucauacaauucaaucucugauuuaauggagcuuguaguucaaaggcagagauggauauguga

SEQ ID NO: 4199658 - RNA, 58 nt, Human
ucauacaucuuguauaucuaucugaugauuaucauuggaguagugauuaagagugugg

SEQ ID NO: 4199659 - RNA, 64 nt, Human
ucauacauguuguguucaaaugguggauucugaauuucaguauacuuaugaauaucagguauga

SEQ ID NO: 4199660 - RNA, 76 nt, Human
ucauacccaguuaguuguaaguauucuagagugaaauuuuaaaaaacauuuuaagaaauguaugacugucugguga

SEQ ID NO: 4199661 - RNA, 66 nt, Human
ucauagaaauguggccagaaacaguuuccugagaaauggaugugguuuggccuagauuuuagauga

SEQ ID NO: 4199662 - RNA, 61 nt, Human
ucauagaaguaguauccacauuuccacguaagguggcauccuggguccugcuucuuccuga

SEQ ID NO: 4199663 - RNA, 63 nt, Human
uccauagaauuaggggcuaugccgguuaacauaugagcugagcuguggccaccaauuuaggga

SEQ ID NO: 4199664 - RNA, 60 nt, Human
uccauagacgugaaugccaguuauagcaguaaccugcucauuggcacaccuuuuauugga

SEQ ID NO: 4199665 - RNA, 58 nt, Human
uccauagcuuuggcacuccgcuggcagcaggacgaagccagguaggcaguggcaugga

SEQ ID NO: 4199666 - RNA, 74 nt, Human
uccauaggucuguacccuguccuucugugcucuuagaguuccaggaggccaggagggugcaggcugugucugga

SEQ ID NO: 4199667 - RNA, 79 nt, Human
uccauaucagaaauccugggcaaaguaugcugucuacucuaagauaugguuuagcagaccugucuaggcaagagaugga

SEQ ID NO: 4199668 - RNA, 61 nt, Human
uccaucagauucccuccugagagcugaucucaacagggcauaaggagagaggaucugagga

SEQ ID NO: 4199669 - RNA, 79 nt, Human
uccaucccuuuccugguuaaaauggugcucaaucugcaaguuggcuauuuggccagaagagggucaaaucaacaaggga

SEQ ID NO: 4199670 - RNA, 72 nt, Human
uccaucuagaaucuuaauucugccuuucauguaacauaaaauguucagaaauuaggagaauaaagaugugga

SEQ ID NO: 4199671 - RNA, 70 nt, Human
uccaucuggaccuacuaauugagauaauaggucagggagaccugggucuguauugguagguaugauugga

SEQ ID NO: 4199672 - RNA, 129 nt, Human
uccaucuggguguuaccgcaaagggcaggauggaagucaguguggcccagggcugugucccagcuaguuuaccaaauugaucuucccuagugauucugacaucucuguggagggcuagggugggaauaa

SEQ ID NO: 4199673 - RNA, 80 nt, Human
uccaucuguuaaauauggugucaggugcucaccuucagaaggggcagcugauuagcaucaaggauguuuagcaauaagga

SEQ ID NO: 4199674 - RNA, 130 nt, Human
uccaugacucaguucauguuuccaucaccugcaccgagcuccucauuuggagggugguuuuauuccagugguggagcaaacaacaauccaaugggagcugcgagaagauuuggaagagaauugacguggg

SEQ ID NO: 4199675 - RNA, 55 nt, Human
uccaugagcuagggauucaucaguaaugagacagauguggcucccuuccucagga

SEQ ID NO: 4199676 - RNA, 87 nt, Human
uccaugaguuugcaaugaaguucuagugagaaaugcucuauucauaaagcaggggguuuacguggaccuucuaguguugcuuauggg

SEQ ID NO: 4199677 - RNA, 56 nt, Human
uccaugcuuacuugucucagcagauugagcuuucuguugauuugguaugagcugga

SEQ ID NO: 4199678 - RNA, 66 nt, Human
uccaugcuuugcuaugacucaccagcacugugaauguuacucugcuguagucaaagcaaagcugga

SEQ ID NO: 4199679 - RNA, 60 nt, Human
uccauggagauggaugacuguaaccuguuggaaccucaguuuucucaucugcaaaaugga

SEQ ID NO: 4199680 - RNA, 56 nt, Human
uccauggcuccauccuguugcuaguggcaaugcuacgagcuggaaggaggccugga

SEQ ID NO: 4199681 - RNA, 63 nt, Human
uccauggggcaagagaggaagcaguccaccugaugugggcagggaucucuuuugcaaguguga

SEQ ID NO: 4199682 - RNA, 78 nt, Human
uccauguacguauauaugcaugcccauguauacacauacagacauguguauacauacauauguguguguauaaaugga

SEQ ID NO: 4199683 - RNA, 72 nt, Human
uccauguccuuuaguguucuaagaacauccaugcaggcuuuggcccgucugggauuggaaacugggauugga

SEQ ID NO: 4199684 - RNA, 60 nt, Human
uccaugugacgguggcaguuuuugggugaaaauauuuugucagcggcucuaacauaugga

SEQ ID NO: 4199685 - RNA, 66 nt, Human
uccauguugagaaugcuauaaugccaguuuuuaaaagauguaauuaugcucagcauuccagcugga

SEQ ID NO: 4199686 - RNA, 111 nt, Human
uccauuaauuucaagggacacaauucaaugcauaccaugucaucuuuguuuaguccaacaauaaauagggaugagcaacugguaguggaggugagacgggugaggagugga

SEQ ID NO: 4199687 - RNA, 110 nt, Human
uccauuauuucugucaagaagacaauuccaaauguugauuaguguuuagacuuacugauuaucagucaagcuaauugauccacaaaaucuaucuugcagaguuucaagga

SEQ ID NO: 4199688 - RNA, 82 nt, Human
uccauucagcaauacuauagccuuucagagcucaugaauuaaagacaugggcaauguagauucuguagauucagugugugga

SEQ ID NO: 4199689 - RNA, 101 nt, Human
uccauuccuuucagccuucuaagaauugaugugaauugcagccagaucaauuuggcuguggcgauugguaucgauuguguagaugggcaaaaaagaaugga

SEQ ID NO: 4199690 - RNA, 60 nt, Human
uccauucucaaggugaagcuaugaauaagaguguugucauuuggaagccugagaguguga

SEQ ID NO: 4199691 - RNA, 63 nt, Human
uccauugcaaagcaauguaggucagcuucuaaacaaguaagccugaaaguaauuguuuaugga

SEQ ID NO: 4199692 - RNA, 114 nt, Human
uccauuucauaaagaagaaaacauagauuuuagguuagaucgacccagauuugaaaccuacuagcugggucgcucuaaccuaaaaucuauacuuuucuuuaaagaauaaaugga

SEQ ID NO: 4199693 - RNA, 74 nt, Human
uccauuuccuucggacaguuuggguuugguuuucuuuuaccugagacucaaagacccugaaugcuagaaauggg

SEQ ID NO: 4199694 - RNA, 109 nt, Human
uccauuucuagaaagacucugacagaccaaguuuccagcagguguggcaaaugcaugucaucuuggauugacuggcucugccuacccagagugcuguuuggauaaagga

SEQ ID NO: 4199695 - RNA, 125 nt, Human
uccauuucuagguuguuguuggcugugucaccuugggaaaguuguugaacacauugagucaaauugagagagacaucaauucagcauuuuaaggaauagauacaguuaucaaguuaccuaaugga

SEQ ID NO: 4199696 - RNA, 107 nt, Human
uccauuuuuaucugaaauaugauucuucugagcuuuauagcccuauuacaugauauccuaucacaugaaaugcuguaaagaagaaugagaucauguaggugaaagga

SEQ ID NO: 4199697 - RNA, 62 nt, Human
uccauuuuucaugacuccucaagcuagucauaaacuccauagaaaggaacaugaacaaugga

SEQ ID NO: 4199698 - RNA, 71 nt, Human
uacuaauacauaauaucuccgauuacuugcagguuguucucuccugacaggcguugggguguugguuagug

SEQ ID NO: 4199699 - RNA, 77 nt, Human
uacuaauggcagccuuuaagcuuggauagguggguaauagugcuugaccaaucugcuuaaaugcugacuguagagua

SEQ ID NO: 4199700 - RNA, 78 nt, Human
uacuacaugaaacugaaggacaaccagaagaacuggaagcgcuaugaccuucugaauguccuugaguucaaccaggug

SEQ ID NO: 4199701 - RNA, 63 nt, Human
uacuagaucagggauuuguaauauggccucugagccaaauccaaucuauccucugauuuugua

SEQ ID NO: 4199702 - RNA, 87 nt, Human
uacuaggaaaaacaagguguuaugaugucuugauaaacauuugguaagauaggagucuuguuacacauaauaacauuuuucugagua

SEQ ID NO: 4199703 - RNA, 56 nt, Human
uacuaggaaugggcuaucccaagcugcaacaccuuggaaaugcccauugccucgua

SEQ ID NO: 4199704 - RNA, 67 nt, Human
uacuaggaauggugcucagcagaaauccugcaacauauggaucuguuuacacacuauucacugugua

SEQ ID NO: 4199705 - RNA, 75 nt, Human
uacuaguuucuaccuuacagaaaguaucauagaaaauaucaaauaaauacuuucaugugagcauggaaugaggua

SEQ ID NO: 4199706 - RNA, 60 nt, Human
uacuauaauauaauuuuucccuuugccuuugcugguauuggagaaggacaauguugagua

SEQ ID NO: 4199707 - RNA, 91 nt, Human
uacuauagcuauaagguaugccuaacauuggauagagugauuucuccuccuuaaucguuuuucaguggucuuaggucuucuagguguagug

SEQ ID NO: 4199708 - RNA, 88 nt, Human
uacuauccuacugucauuuuuuuagaacaccuguauuuuuacauaagauuuauuuuaggggauguuugccaaugauuuuuagguagug

SEQ ID NO: 4199709 - RNA, 89 nt, Human
uacuaucugauaugacacaguguaguuaaugugacauuuauaaaaacaaauguccuguuaaauagauuguauuagucauccagauagug

SEQ ID NO: 4199710 - RNA, 114 nt, Human
uacuauuuacaagauuuuauuugcuucauuuuaaauaaagacaauuuuauacagaaaagacguugguaauagugaagugaaguuaauuguaagaauuuuucuuugcaaauagug

SEQ ID NO: 4199711 - RNA, 94 nt, Human
uacuauuuucaaauagcaaagaaggguucuucauuagguugucaaaucuaauuuugugugagcuuuaucuucacucugcuguuuuaaaguagua

SEQ ID NO: 4199712 - RNA, 84 nt, Human
uacucaaacuuuacaauggauaaggaaaauuggguuguauguaaaaauacauuauccugucuuuguccuuguagacuuagggua

SEQ ID NO: 4199713 - RNA, 103 nt, Human
uacucaccccuuggagaccuguuuguuauuuauaacagugagaacgggggaccuagugccucccuccuggugaugaugcaaauggucaaggagauagugagug

SEQ ID NO: 4199714 - RNA, 67 nt, Human
uacucccuuguugcagcugacagauacauauaccuaaguguaugugucccuugguguagcaacagua

SEQ ID NO: 4199715 - RNA, 84 nt, Human
uacucguuuuucaggagggcugcuggugacucagacccgguguggcugggccuggcucugagggagcuccugagagccugagua

SEQ ID NO: 4199716 - RNA, 59 nt, Human
uacucugcucauuggaguguguucuucauguucacgcacaaguuuucaggagcauagug

SEQ ID NO: 4199717 - RNA, 72 nt, Human
uacugaaugaaugaauuaauagaguauguaguuuuuuucugccuugggcucucuccauuuauuugcacagua

SEQ ID NO: 4199718 - RNA, 70 nt, Human
uacugacuccugggucccaucccaggccauuuacaccaaaaucucuggggguagaacucaggcaucagua

SEQ ID NO: 4199719 - RNA, 67 nt, Human
uacugagaauucuagucugacagugcuacauuguguagcacauuguugaccagaaggaauuuuagug

SEQ ID NO: 4199720 - RNA, 96 nt, Human
uacugaggaagcagcagacgucauuaugugcguacauguaucuguguguuauaugugcauguauguauguacauauguaaucuaauucccucagua

SEQ ID NO: 4199721 - RNA, 66 nt, Human
uacugauaaacagugcuuugaccaggggccuccaggccugagacugaaggcacaguuuaaccagua

SEQ ID NO: 4199722 - RNA, 66 nt, Human
uacugauaugaugugcuuuagaggauaagcagggcaagaaugcuuugaucugaauauuaugcagug

SEQ ID NO: 4199723 - RNA, 66 nt, Human
uacugaucaggggccccuguagacuguaagauguuagaucgccaggagccagcccuguucucagua

SEQ ID NO: 4199724 - RNA, 69 nt, Human
uacugaucuaaauggcugugcuaaaaugaguguuucacgacacucauuuuauaacacuguaguuuagua

SEQ ID NO: 4199725 - RNA, 92 nt, Human
uacugaugauuacuuguuuugauaagaugcugagugcauugacuuaguaccuguguuaauugcuuuauccuguuagaaucugauuuucagug

SEQ ID NO: 4199726 - RNA, 77 nt, Human
uacugcccuaagguaauuugcuagaaauggaguggucaagauguauugauuaacguuuuaggcauacuucuguagua

SEQ ID NO: 4199727 - RNA, 58 nt, Human
uacugccuucuuuaauccuaguuuuacucuucuuaacaagucuaagagaauggcagug

SEQ ID NO: 4199728 - RNA, 65 nt, Human
uacugcgaaaugcauaaucuuaguagauuucuuuccugagauguuacugucugugguuuccagua

SEQ ID NO: 4199729 - RNA, 67 nt, Human
uacuggaguuuuucaagaaacuguuuaaguucacuuuaacuuacagaaguauugagagauccaagug

SEQ ID NO: 4199730 - RNA, 60 nt, Human
uacuggcuaugucccaaaugcuacgucaguagcagagcugcaauauagaccccaaaagua

SEQ ID NO: 4199731 - RNA, 87 nt, Human
uacuggguuaauguuaucugaagacaguuuuuuugugguuuaauugagucaugguucauugucuuuuauugcauguuaaugccagug

SEQ ID NO: 4199732 - RNA, 94 nt, Human
uacugguuggcagucguuugcagaguaccugaagaggacaguaaaauacacaaaagaaugcugugcugguagucugcaaaucagagcaccagua

SEQ ID NO: 4199733 - RNA, 73 nt, Human
uacugguuuagagaauuuuaaaagccuugaauaaguaaaauucagggaaaagguaaaauucuaggaaagagua

SEQ ID NO: 4199734 - RNA, 86 nt, Human
uacuguaugaauuguauuguauuauuuuagagaccuccugugaauggaggucucuaaaauagucaaacucauagaagcagacagua

SEQ ID NO: 4199735 - RNA, 58 nt, Human
uccuaggguaaucagcauacauuguagccuuuaagauaugugguugucuguccugggg

SEQ ID NO: 4199736 - RNA, 57 nt, Human
uccuagucaccugaaucaugcaaagaaauuccgcuuuccaggagcacgggacuagga

SEQ ID NO: 4199737 - RNA, 68 nt, Human
uccuagucuguagucacacaggugacagcugggguugcaucuguuccuugccuacaggugaacuggga

SEQ ID NO: 4199738 - RNA, 109 nt, Human
uccuauaaacuccugaaaccagccucuagauaaggauuucucaacuucggaacuauggacauugggguuaauuauucguuguugggaggcugucauagacauuauagga

SEQ ID NO: 4199739 - RNA, 114 nt, Human
uccuauaacuuuucuucauguggguuucuaccgaauauaaauacugaguuuggaauuuggcuucaagucguauauuugggagggaacagcaggucacauagugaaggcaugggg

SEQ ID NO: 4199740 - RNA, 89 nt, Human
uccuauaaggauucuuacgagccuuaugcaggcacuugccuaaguaccugcauaaucccaggcuugcauucaaagcaguccuuagauga

SEQ ID NO: 4199741 - RNA, 69 nt, Human
uccuaugaaaauuuccaucaguuauaugggauuuuaauucugauauucuugaagggagauuauaaagga

SEQ ID NO: 4199742 - RNA, 63 nt, Human
uccuauucuuuguccuguugagagcuggcaccagcagcaguggcaaugggacagagcacagga

SEQ ID NO: 4199743 - RNA, 94 nt, Human
uccuauuucuuuguuaaggaguauugcuucuccaaaaagggcucuaacaaccucagagauugcaauuccuuacaugcaauggaaugccaaugga

SEQ ID NO: 4199744 - RNA, 59 nt, Human
uccucaaaggauacccaggcuucauuuacaggcaagaagccagagggaaucuuugggga

SEQ ID NO: 4199745 - RNA, 78 nt, Human
uccucaauuucuucucugccuugaggcaauugcuuacuuugagaacauuuugccagcuagagaagcuagaaaggagga

SEQ ID NO: 4199746 - RNA, 61 nt, Human
uccucacaagcaagcacagguagugggcuccaggagccgaggcagagcuguucugugggga

SEQ ID NO: 4199747 - RNA, 73 nt, Human
uccucacauguagauuuuuuuagaucauagaaucaaucuacuucugggccuauagaagucuacccauuaagga

SEQ ID NO: 4199748 - RNA, 56 nt, Human
uccucacugugaccauagguggguacuguuauuuguuugcauuuuacaugugggga

SEQ ID NO: 4199749 - RNA, 57 nt, Human
uccucagaauggauggcagggguugcaaaccaugugccugccuuccaugcugaguga

SEQ ID NO: 4199750 - RNA, 57 nt, Human
uccucagacuucccuuuguguagagccucaaggucagccagaggugagaguuuaggg

SEQ ID NO: 4199751 - RNA, 90 nt, Human
uccucagauuccugucaauaccauuucauucuuuccucauuuugggagaagggaaggagggaaggaaguaaggaaggaaggaaggaagga

SEQ ID NO: 4199752 - RNA, 74 nt, Human
uccucagcugugaaauguggauguuaauaguagcuacuuccuagaguuuguugauuaaacacaucauguaagga

SEQ ID NO: 4199753 - RNA, 57 nt, Human
uccucagucucucaaaugaggcagauauuauuaucaucuucauuuuacagaugagga

SEQ ID NO: 4199754 - RNA, 63 nt, Human
uccucaguuauaaauaggaaacaccucuaaucuugagggaaaccauuucuguguaacugaaga

SEQ ID NO: 4199755 - RNA, 55 nt, Human
uccucaucuguaccuugggguaaaaauucccacaccccagggguuguggugagga

SEQ ID NO: 4199756 - RNA, 63 nt, Human
uccucauggugauuuucaucucugcauucccaagcguguagaugaagggguucagcauggggg

SEQ ID NO: 4199757 - RNA, 77 nt, Human
uccucauuuguaggaagggcucagggcucgguggguaagccagacacugagcuagguccuucuugcccagcugggga

SEQ ID NO: 4199758 - RNA, 56 nt, Human
uccuccaagcagaggcccugaagugacugcauuuugagucucugaaauuuggaaga

SEQ ID NO: 4199759 - RNA, 67 nt, Human
uccuccagcagcagggaggggaggacuggcugucucagaaucuuuuaaaagcccugcugucugagga

SEQ ID NO: 4199760 - RNA, 82 nt, Human
uccuccagccuccuaucugcuuuaucugagacaagucaaguguguguggcaguuggggaugaagugaggagaguugagggga

SEQ ID NO: 4199761 - RNA, 76 nt, Human
uccuccaugcacugccccucugcaccucccagaagauuaggguggggguggagugggagcgguggaucuuuuagga

SEQ ID NO: 4199762 - RNA, 58 nt, Human
uccucccacaagggccagcucaccuggucgccccaaagaccucccucuguggguggga

SEQ ID NO: 4199763 - RNA, 104 nt, Human
uccucccagaaccaaaugaagaaacugaggcuuagagaagaugggauuuuucagcuaaaagaucuuucucuugaacucuaaagcccaggcauguucuggcaggg

SEQ ID NO: 4199764 - RNA, 73 nt, Human
uccucccccagcccaugcccuuauagcauaaccggauuagcuggcugggcugugggcuguugcagggguaggg

SEQ ID NO: 4199765 - RNA, 99 nt, Human
uccucccccuccucccaggagcgcugccuccugccgugcagcuuccuccuccuaggugggacuuguggguagguggcugaugaaggaggaggaggagga

SEQ ID NO: 4199766 - RNA, 71 nt, Human
uccuccccgcgcugccagacucacucggagccaccaacgaccugggaggugauggcaagcagcggguugga

SEQ ID NO: 4199767 - RNA, 128 nt, Human
uccuccuugcgcugguccuggccacugaugacguagcagagcgcgcgcacgcgcuggaagaacuccucauccaccaggugggcgcugcucccgcugggcagguaggccagguccagguagaccgggga

SEQ ID NO: 4199768 - RNA, 56 nt, Human
uccuccuuguucuuuugccuacauugauaaguguugggguugggggugcaggaggg

SEQ ID NO: 4199769 - RNA, 66 nt, Human
uccucgcacagugggacccaagaugcauuugggcacagcaggagggaauguccuggugugugagga

SEQ ID NO: 4199770 - RNA, 80 nt, Human
uccucuagaagccccuggaaacuaacaacagagcagagccaucugccauguuucuuauuugcaguuucagggcuuuggga

SEQ ID NO: 4199771 - RNA, 67 nt, Human
uccucuagugugcaacugauauuauaaacaugcuuuuaaaggaauuucauuguugcaugguaggggg

SEQ ID NO: 4199772 - RNA, 85 nt, Human
uccucucaaagcaguuccuuuuaguacucauagcuucaaacugcugucuugguaauuguguuuauuaaaugaauuagugagugga

SEQ ID NO: 4199773 - RNA, 60 nt, Human
uccucucaaauguaauuugagguucauuuuugacccucauuuagcguuuuagauucugga

SEQ ID NO: 4199774 - RNA, 59 nt, Human
uccucuccagccacagaagcugcuccugcaaggagugcaaacauuuucuccuggaagga

SEQ ID NO: 4199775 - RNA, 67 nt, Human
uccucucuucucucuugauaaacgccgaaucuuacgugccugacucuguuuaagagcugaaagggga

SEQ ID NO: 4199776 - RNA, 64 nt, Human
uccucucuuucauuggucgccuuggaggccgcucgccuccggcgcgggcacagagaggggcggg

SEQ ID NO: 4199777 - RNA, 58 nt, Human
uccucugaaauuggcccucagcaggucacuaugccaugaugauaggaguuuuagggga

SEQ ID NO: 4199778 - RNA, 96 nt, Human
uccucugcaguuguuacaaaggucauaaaagugugcuagguguuuauccaggaagaaaauauauuuuuauucuuuuuuaauaacaggagcagggga

SEQ ID NO: 4199779 - RNA, 61 nt, Human
uccucugcucagcauuccucaccagguacucauuaggcaaugaggaugugcagcagcagga

SEQ ID NO: 4199780 - RNA, 82 nt, Human
uccucugcuggccuccuccucugucugcaugcgugcguccuugcaagggaaagacgcagcacaaaggaaaggaucaggagga

SEQ ID NO: 4199781 - RNA, 70 nt, Human
uccggugccugguuuggggaauguucgugggauauguuccaaaggacugacggaccuaucagguacugga

SEQ ID NO: 4199782 - RNA, 130 nt, Human
uccgguuuccuagggagcucugcugaagcagcccagccuccguggguccaucugucagggaggcuguuccgccccaucgauugcuguucccagggggcugugcugcucgagggacccaauguggccgcca

SEQ ID NO: 4199783 - RNA, 68 nt, Human
uccguaguaugauuucugagcucccuuguucuccuucuucaagggagcagagcucuucaucugcaggg

SEQ ID NO: 4199784 - RNA, 95 nt, Human
uccguauagagagaaacaguguugcuaaguucugaacuaguuauacuguaaaauggguuuaacagaguaggaacccuguuuuucaccuguaagga

SEQ ID NO: 4199785 - RNA, 58 nt, Human
uccgugcuccuuccucauccugugcaucccucugaugguagaggaggaggcagcagga

SEQ ID NO: 4199786 - RNA, 58 nt, Human
uccuaaaaguaaucaaacauuuguggguucacaucacgcuauguucauauuuuuaggg

SEQ ID NO: 4199787 - RNA, 113 nt, Human
uccuaaaaucccuaauucuuuaaaacugccuguguuucauuauaaaaaguuggcuuuguguaauuacaccgagccauacaaccuauaaagugaaaauacugcagauuuuagga

SEQ ID NO: 4199788 - RNA, 72 nt, Human
uccuaaagacaaugcauugugauugugaccagaaggaaacuuaaguccaaguccucagugaauuaucuggga

SEQ ID NO: 4199789 - RNA, 71 nt, Human
uccuaacuccuggcuguaugcuggccucagagcuacacugcucagauggagcaugugagccccuuauggga

SEQ ID NO: 4199790 - RNA, 59 nt, Human
uccuaacuuggcuguaaaaucagaggcuuggcauagccuuagauguaaauaccaaggga

SEQ ID NO: 4199791 - RNA, 83 nt, Human
uccuaagauagagaaugagggacuaucauaaaagaauuauugcucagggauacuucuucaaaguccuuauuccuuucuugaga

SEQ ID NO: 4199792 - RNA, 55 nt, Human
uccuaaggagauuguuaaagcuauaugaaaaauguaagcuaaaaaucuccuugga

SEQ ID NO: 4199793 - RNA, 79 nt, Human
uccuaaguguaauaaugcauauucuuuuucggaugcuuauaauaugguguugguaaauagcuuagcaaugcacauagga

SEQ ID NO: 4199794 - RNA, 68 nt, Human
uccuaauggcaguaacagaggguuugcagauaugcucauugacagcauggcaggguccuguuacagga

SEQ ID NO: 4199795 - RNA, 76 nt, Human
uccuaauuaugacuuguagaugauaauuucuagauacucuccuacuagaaaugaauguuuaaaaguccuaagagga

SEQ ID NO: 4199796 - RNA, 110 nt, Human
uccuaauuuugcaaauagcuugauuccaucauguuuuaauuagcaaacugauuauauucaagagauuggugaaugaaaaguagauuaagaucagugcagcagaauuggga

SEQ ID NO: 4199797 - RNA, 82 nt, Human
uccuacacauguccuuuuauuuaaagcaggcaaagucagaauuagcugaauaguccuguccuaaggaaaggagcaguguuga

SEQ ID NO: 4199798 - RNA, 66 nt, Human
uccuacauuuguucaaauaagcugagaaauccuugguacucaguaugucuacuggacaaaguugga

SEQ ID NO: 4199799 - RNA, 83 nt, Human
uccuaccagacugugccagcccugggagacuuauggaaagacacuuugaucacaggagcccaggggagcuguagcaaguggga

SEQ ID NO: 4199800 - RNA, 61 nt, Human
uccuacgaaggcuucucacuuugguuuucccuaaaaccaggacauuuuagucaucuuagga

SEQ ID NO: 4199801 - RNA, 92 nt, Human
uccuacuccuaccucuacucccugccacugcaccuguaucaguuuuaguuuugcugagguuucaggaguggcaggggagaguagguacagga

SEQ ID NO: 4199802 - RNA, 106 nt, Human
uccuagaaaaaaagaaauugaaaacugcagggaaaguguuggcagcaucccagacuuucuuguuuugcugcuaaucacucugacagcggauuucuuuuucagagga

SEQ ID NO: 4199803 - RNA, 62 nt, Human
uccuagaaggaucauucuaguggcuauccuacagccacuugagaggauuguccuaguuggga

SEQ ID NO: 4199804 - RNA, 130 nt, Human
uccuagcuacacuaauauuuauagaauguugauauuggaugggccuuggagagcacauaauucaaauuuuuaguuuucagagaggcaauacuguuuaauauaaagaguuuuggcaaccagguggcaaaaa

SEQ ID NO: 4199805 - RNA, 122 nt, Human
uccuaggcaaaaguuuucacacuguuuucagucaguucuauguaguuauaauagaaugaaucuuccuaauuuaagucauagaaugauaaaagcagugaugaaaagagaauguacaccuagga

SEQ ID NO: 4199806 - RNA, 57 nt, Human
uccuaggcuaaagcuccggcucuggguggaccagagacaaggagcuggaguccaggg

SEQ ID NO: 4199807 - RNA, 130 nt, Human
uccuaguuacccagaaguaauuaugaaccaacucucgggccaacugggucuguccucugaugcuaucaaagucauauagguaggauucagcuucgugguuggcuaguaauuaaaaagcugcaagcuguga

SEQ ID NO: 4199808 - RNA, 73 nt, Human
uaguuuggugcauaaguaauugcagcaauuugccaauaauggcaaaacccgcaauuacuuuugcacuagccua

SEQ ID NO: 4199809 - RNA, 72 nt, Human
uaguuuguacacaaauaauaaaguuacauacuauuaguguguugugaaagaaaaguauuugugucuaaauua

SEQ ID NO: 4199810 - RNA, 83 nt, Human
uaguuuguucccaaaugcucacccaugugcuagguguacaaagccaucacagcaaugacuaaggcacuuugggaaugaugcua

SEQ ID NO: 4199811 - RNA, 65 nt, Human
uaguuuuacauuaucuuaggugcgugguuuuuauuaaucauccacuucacuggaauguaggucug

SEQ ID NO: 4199812 - RNA, 68 nt, Human
uaguuuuacuuaucuuuugguuaucacaguuaaaacaaacuaugcuaacugggggaaaagagauccug

SEQ ID NO: 4199813 - RNA, 74 nt, Human
uaguuuuaucuguuguacauuuaugcugauaacccuuuauuagguuagaugcagaaaguauauagauauaauug

SEQ ID NO: 4199814 - RNA, 129 nt, Human
uaguuuuaugugucaacuugacuaggcuauaguacccagauauucaaccaaacacuaauccaggugugcugagaagguauuuugugaauaugguuaauaccuaaaaucaguugacuuuaaguaaagaag

SEQ ID NO: 4199815 - RNA, 74 nt, Human
uaguuuucucgaggaaauauuuacaacugauugaauuuaauuucaauuguacuaauuuuccaugaguugagcua

SEQ ID NO: 4199816 - RNA, 130 nt, Human
uaguuuucuucccuguccgacacccugcucugugauucucuggggacuucaaaaguaaguaggugcaguucaugagcuuuggggaagaauacagaaaagugggucaugggcagugagaagcugaaaauua

SEQ ID NO: 4199817 - RNA, 72 nt, Human
uaguuuucuuuccacuccccgucaguugugagguauaugacugcaggcacuggagucugaggaagaaaacug

SEQ ID NO: 4199818 - RNA, 79 nt, Human
uauaaaaacagguggcuuauuagggucaguggaacauaauucaaaggcugaauuauuaauaugcuacaucuuuuuuaua

SEQ ID NO: 4199819 - RNA, 72 nt, Human
uauaaaaaggagagcaaggguagggacacuuuuuccuccuuaaagacuuguccccuuucuuuccuucguaug

SEQ ID NO: 4199820 - RNA, 82 nt, Human
uauaaagaacagacugucguagaaaacugucuuugcuuccaaaucagcagaggaccauuguauguauugucaggucuuuaua

SEQ ID NO: 4199821 - RNA, 67 nt, Human
uauaaggguugaacauugcuuauaauauacccauaauaggguagaagaagcauggucaaaacuuaug

SEQ ID NO: 4199822 - RNA, 64 nt, Human
uauaaguagaaagaguugggaggaauuuuaguuggguuucauucuucuaaacucuauacuggua

SEQ ID NO: 4199823 - RNA, 114 nt, Human
uauaaugaugaaguaagugcagacauguguucuaacaggagcuuugcaggaagacaaagcaaauccauuucuagaauaaguguuucccaguaagaaaaagaaauucucucuaua

SEQ ID NO: 4199824 - RNA, 71 nt, Human
uauacaaugaguacauucuggggaucuaauguacagcauguugacuauaauuaaugauacuacauuguaua

SEQ ID NO: 4199825 - RNA, 56 nt, Human
uauacacaaacaagggguuaaguucagagacuauaauccuauuuuguguguguaug

SEQ ID NO: 4199826 - RNA, 64 nt, Human
uauacacauuacaguuucaggagcacugggcuagucccaugguuuucagacuuuaaugugugug

SEQ ID NO: 4199827 - RNA, 65 nt, Human
uauacaggaaauuuuggaacagugagagaugaaaccaaggagcauugauucgagauuuuugugua

SEQ ID NO: 4199828 - RNA, 57 nt, Human
uauacagggcaagcgaaggcagagcucaugcuccacagcuuugcaaagcccugugua

SEQ ID NO: 4199829 - RNA, 83 nt, Human
uauaccccauaaguagugcugagcuccagcuuagcugagccaagcucaguccuuaucugguguucagccagugcacagguaua

SEQ ID NO: 4199830 - RNA, 60 nt, Human
uauaccugucaaaagacauggagaucagcagcacaaucucagucccauugaagaggugua

SEQ ID NO: 4199831 - RNA, 64 nt, Human
uauaccuugcuaaauuguuuucuagaaagcuugaaccaaguucugcacauuuuagcaaaguaug

SEQ ID NO: 4199832 - RNA, 63 nt, Human
uauacgagggacauuaaaggcacuguuaggauuugaugacagcugccaagaaucuuuucuaua

SEQ ID NO: 4199833 - RNA, 61 nt, Human
uauacuauuuuccacuugucacgcuuuuaaccauuagaagaggaggaggaaaacuagugua

SEQ ID NO: 4199834 - RNA, 101 nt, Human
uauacucuugcuggcaguguaugaacauguucauugacuuaccaacacuauacuaaucugguagguaugucucauuguucgugugugugugugugugugug

SEQ ID NO: 4199835 - RNA, 95 nt, Human
uauacuguauuuauuucauccucucuguuuucguguaugugcugaaaugcauaucuugaucaaguagaagaggauaugauauauaaauacguaua

SEQ ID NO: 4199836 - RNA, 111 nt, Human
uauacuuuaaguucuaggguacaugugcacaaugugcagguuuguuacauauguauacacgugccauguuggugugcuguacccauuaacuugucauucauauuagguaua

SEQ ID NO: 4199837 - RNA, 61 nt, Human
uccauccuuuacauccuucugucuguucaagaaccagucugggaucuuguacuggcgugga

SEQ ID NO: 4199838 - RNA, 129 nt, Human
uccaucuuucccucaguguccugugggcaagugucccagccccacaggccugugaaaaggcaccagccccucucccaccggccuguggggcugggacacuugcccacaggaccccgagggaaaggcaag

SEQ ID NO: 4199839 - RNA, 56 nt, Human
uccaugagacagauacuguaagguaaauuuauccuuaagccuaucuguaacaugga

SEQ ID NO: 4199840 - RNA, 55 nt, Human
uccaugaggauuggaaauacgucugcuguguucauugcagucccaaaccuuagga

SEQ ID NO: 4199841 - RNA, 106 nt, Human
uccaugcuuuauuccuuuggggcucagcaggcuguuuucaucuugccuggugaaacaaauguguggcagugugggagagcucauaaggaacagucugaaaugugga

SEQ ID NO: 4199842 - RNA, 55 nt, Human
uccaugggaaugcuguggccacaccuggggcguuggcuacagacauuccuaggga

SEQ ID NO: 4199843 - RNA, 75 nt, Human
uccaugggccaguaaugcuggagguuuguuagaaacgcaacuuccaggccuuccuucccagccuacugguuugga

SEQ ID NO: 4199844 - RNA, 87 nt, Human
uccaugguaguuacuugcacacuuucagguccucuuugcuacucuaagguaauaugcaaauuugaagauguugcuugacucaaugga

SEQ ID NO: 4199845 - RNA, 89 nt, Human
uccauguaagguucaagaacauuucagcaaauaagaacagcauuuucauucuguuucuuuugaguuucugaaugaucugaacauaugga

SEQ ID NO: 4199846 - RNA, 81 nt, Human
uccauuagcauaguuacaaacuugagauccuuugucuuugguagaacuuaaagauaaugucaaauucugucugcuacugga

SEQ ID NO: 4199847 - RNA, 129 nt, Human
uccauuaguacugugucuguuucuucugaccaguguauccccaguagcuagcuuaaaugccuauccauucuuuauuuauuuacagugugccuacuauaugccagauguuauagauaauagaaaaaugga

SEQ ID NO: 4199848 - RNA, 84 nt, Human
uccauuaugccauuugauuuucaugauaaacuugugaagugauacuauccuccauuucacagaugagaaaucugaggcauggga

SEQ ID NO: 4199849 - RNA, 62 nt, Human
uccauuccuuguauaucuacaugcaggaucccaacugcauucaaugugccagggaaaaggga

SEQ ID NO: 4199850 - RNA, 63 nt, Human
uccauucucauucccccaggcacuccaguaaaugcaauacagauguggcaggaugagggcgga

SEQ ID NO: 4199851 - RNA, 75 nt, Human
uccauucuucuguaucucuguguuucuugaucuaauucugggaauccaggauccacaugagacuggagaggggga

SEQ ID NO: 4199852 - RNA, 67 nt, Human
uccauugauacuauuaagcacugggcuaggaaugacuagccuaagaucacuuauagagucacaugga

SEQ ID NO: 4199853 - RNA, 72 nt, Human
uccauuggagucggcuuuccaggaaacccccugcaccacuguaguacaggcaggaguuccuggacuccagga

SEQ ID NO: 4199854 - RNA, 80 nt, Human
uccauuggccugcugggucucuggguguaacaagaggcaaagacucaggugucuuggacacugagacuagcaagcaggga

SEQ ID NO: 4199855 - RNA, 102 nt, Human
uccauuugcauaaggcaugaaaaacugguuaggacugggugugccaugcauagugcacgaaaaggcuggccacccacccuaaucuuucauuaagcagauggg

SEQ ID NO: 4199856 - RNA, 56 nt, Human
uccauuuggcacucuauuuccauaaugcgauuccgcagcguacgggcgucagagga

SEQ ID NO: 4199857 - RNA, 84 nt, Human
uccauuugguaaacgcauuauaucccucugugauaucuugaauauucauauauguauuagagcauauaauuugacuuaugugga

SEQ ID NO: 4199858 - RNA, 66 nt, Human
uccauuuucauagcucucaguuugggauucacgagccuauuguguuacugagcugcauggagagga

SEQ ID NO: 4199859 - RNA, 69 nt, Human
uccauuuuccugcuucuacuucacuuccuagaauaauucgggaaaugguagaguaggaagauuucugga

SEQ ID NO: 4199860 - RNA, 60 nt, Human
uccauuuucuaaguaucacuuauauacacaauguauuaucaggugauccaggaaaacgga

SEQ ID NO: 4199861 - RNA, 88 nt, Human
uccauuuuuuuccauuauacuuuguguucaacguaguagauuacacguaaagacagcaagauacaaaauauaaauggagagaaauaga

SEQ ID NO: 4199862 - RNA, 65 nt, Human
ucccaaagugcuggaauuacaggugugagccacugcgccuggcccccaguacuuugucaaaugga

SEQ ID NO: 4199863 - RNA, 62 nt, Human
ucccaaauggauacaggcaaacauuuccuuaacaaagucaaugugcuguauucauuucugga

SEQ ID NO: 4199864 - RNA, 81 nt, Human
ucccaacaguuuagaaugccacauaguucauacucauggaaguagaguacuauauuuggcauuuuauauugucuuauggga

SEQ ID NO: 4199865 - RNA, 76 nt, Human
ucccaaccaccgugcagcuucccugagcccacucccuggcccagcucagagcccgaggcuugcauguuuguuggga

SEQ ID NO: 4199866 - RNA, 62 nt, Human
ucccaaccccagacaccgccucggggccugagcccuugagagccacuccuggggcccuggga

SEQ ID NO: 4199867 - RNA, 68 nt, Human
ucccaagccccaccuucggcugacucuaaggagaaccacagggucaggccucaaggugggcucaggga

SEQ ID NO: 4199868 - RNA, 63 nt, Human
ucccaagcccuggaugccucagcaaggauugucagaaaugucugagaugaucagagcuaggga

SEQ ID NO: 4199869 - RNA, 56 nt, Human
ucccaaguguuuaaaaauggaaaugcauuacuucugugcagcucagacauuugggg

SEQ ID NO: 4199870 - RNA, 86 nt, Human
ucccaaucauaagacccagccaguauuuuuacuacauuuccucuccucaucuguuuguauugguuugguuugguuuaugagugggg

SEQ ID NO: 4199871 - RNA, 68 nt, Human
ucccaauuucucgaacucuaauccaggaccuuaguacucagucuggagaugggucagggaaaaugaga

SEQ ID NO: 4199872 - RNA, 69 nt, Human
ucccacaagaaaccuaaguaacuuuugucuaucaguuucugggaaaggucugcuuguuuucuugaggga

SEQ ID NO: 4199873 - RNA, 106 nt, Human
ucccaccaaaggggcaauugaugcugaugccugccagaagcacugcuucaaguuccaguguuuacccauauuagcaucaagucugccacuauucauuuuggaggga

SEQ ID NO: 4199874 - RNA, 61 nt, Human
ucccaccaaauaguuuuggacuaucaguucuaaucuauguauuucagaaauauugguggga

SEQ ID NO: 4199875 - RNA, 91 nt, Human
ucccaccccauccugucaccccugccucucagccugaccgccauguaacccugggggugcugagaagacaggagaaggggaggggaaggga

SEQ ID NO: 4199876 - RNA, 55 nt, Human
ucccacuguuguuugucucucuggagaagguuauuuucaggcaggcagagcggga

SEQ ID NO: 4199877 - RNA, 91 nt, Human
ucccacuucuuaagucacauggcuucugucuuggaaauuuuaccuuuaaaagauuauuuaagacaggaaccaggaggcuugggaacaggga

SEQ ID NO: 4199878 - RNA, 69 nt, Human
ucccagaaaguucugaugcugaucaaaguuuaagaaucaugcuuugggucaucaguagcuuggaaggga

SEQ ID NO: 4199879 - RNA, 85 nt, Human
ucccagaauccaaucuccagugaggcagauucugcaagcuccuuggcagugccugauucugaugccucauggaucugaucuggga

SEQ ID NO: 4199880 - RNA, 76 nt, Human
ucccagacuauggagccuggguccuucccugggaacacaugguuccagaggugaacacccaggcaagagaggggga

SEQ ID NO: 4199881 - RNA, 66 nt, Human
ucucagcaggguggauuugggaaguggccuggaauauggcaggccuucccucucauccugcuggga

SEQ ID NO: 4199882 - RNA, 130 nt, Human
ucucagccccaucuguccaucagagucacagcagaccccucaccaggcuccacccuacagagcucccagaucggaucccugcugggugggccugcuggguguguauucugaugcucagugggaguugagg

SEQ ID NO: 4199883 - RNA, 73 nt, Human
ucucaggaaaagauuggaaaugacaauggcaguuaaggguugcuguuaguguaauuccaguuuucacuugugg

SEQ ID NO: 4199884 - RNA, 80 nt, Human
ucucaggauuuacuaauuucaaggguguacucuguaagggguugguugaguaaaauuuugagucuagagaaagcuugaga

SEQ ID NO: 4199885 - RNA, 87 nt, Human
ucucaggcagugacccucuagauggaagcacugucuguuguauaaaagaaaagaucgugcaucccuuuagaguguuacuguuugaga

SEQ ID NO: 4199886 - RNA, 85 nt, Human
ucucaggcagugacccucuagauggaagcacugucuguugucuaagaaaagaucgugcauccuuuuagaguguuacuguuugaga

SEQ ID NO: 4199887 - RNA, 68 nt, Human
ucucaggccccugaguuucucuaugaccuucagcagcauagucaggcuuagcagcaggggccugcaga

SEQ ID NO: 4199888 - RNA, 55 nt, Human
ucucaggcuaccuugcacaaggguuucucuuccugugcaaugguuuguacuguga

SEQ ID NO: 4199889 - RNA, 60 nt, Human
ucucaggcuguguguggaggacucagguuccuggugaauccuucuacacugccucugaga

SEQ ID NO: 4199890 - RNA, 65 nt, Human
ucucagguggcuucaucaacugugcuuauguagacauaguauuuacuuuguguggagccuggaga

SEQ ID NO: 4199891 - RNA, 65 nt, Human
ucucaguaacaggcucugugguauaccucuguagguauucaaacacuugagcuugaaugcuagga

SEQ ID NO: 4199892 - RNA, 96 nt, Human
ucucaguacuucuuauacgugcaugauauaugaguuguuuaauaccugaauuaaaaucagaugaugacuauauacaugcaguaagagaugcagagg

SEQ ID NO: 4199893 - RNA, 81 nt, Human
ucucaguauaucaaagaguuuuuaaaauaacaugauuuaauuuacauuuuuuaaaggauagcucugguugcugugcugaga

SEQ ID NO: 4199894 - RNA, 84 nt, Human
ucucaguuguaacuuuuaugucagcaauucaagagcucuuauguucuaauaagauagccuaguggauggcuguggcaacagaga

SEQ ID NO: 4199895 - RNA, 66 nt, Human
ucucaguuuccugucucguuauuuucagcugcugaaagcagugaagguggcauaggagagauggga

SEQ ID NO: 4199896 - RNA, 65 nt, Human
ucucauaaaggugccacucaguuuuagccaugucuucacugaaauugcaaaaguacuuuuaggga

SEQ ID NO: 4199897 - RNA, 59 nt, Human
ucucauccagagcauuuucaagauaugaagucaguauuacauguuuuaugcugauggga

SEQ ID NO: 4199898 - RNA, 82 nt, Human
ucucauccugcaaagagguaaccauagcaaccacgagaggcaucggggagagaggagagaggguuacugaggcagaguggga

SEQ ID NO: 4199899 - RNA, 87 nt, Human
ucucaucguguugagacucgagucucucagaccuuggauucauucccuggugucuuugagccucaguuuccucauugguaaaagaga

SEQ ID NO: 4199900 - RNA, 77 nt, Human
ucucaugacaucuuuaguuauugaauauagaaauuuaaguauuuuaguaugagacugcuagggaauagccauagaga

SEQ ID NO: 4199901 - RNA, 64 nt, Human
ucucaugaggaggcaguaaaucgugacaguauuuucauggcagcacugacugcuuuucauaaga

SEQ ID NO: 4199902 - RNA, 87 nt, Human
ucucaugcaaggcuauuaauagugccuauuuaagauuuuuaagaauucacuugaugacauuaauggcaaauuaauuauugcagaaga

SEQ ID NO: 4199903 - RNA, 87 nt, Human
ucucaugcugugacucucuggagggaagcacuuucuguugucugaaagaaaacaaagcgcuucucuuuagaguguuacgguuugaga

SEQ ID NO: 4199904 - RNA, 56 nt, Human
ucucauggccagaugucucuggagcuaguggcauggcuauacagaauggccagagg

SEQ ID NO: 4199905 - RNA, 56 nt, Human
ucucauguauugcccuggugugacugaggaccaugcucagggaaggccacgugaga

SEQ ID NO: 4199906 - RNA, 63 nt, Human
ucucauuaaaugucacuucucaguugggcuauuacugguaguaugacaggugauaucuugaga

SEQ ID NO: 4199907 - RNA, 102 nt, Human
ucucauuggaugaaguacugcugauuguauagggguuauuaauacuuaauaauauuguuuugacuccuacauaaaacaacuauguauuuuaggccagugugg

SEQ ID NO: 4199908 - RNA, 60 nt, Human
ucucauuuaauucugcccaaaagcaaauguacccaggcuuuugggcaaaauuaaaugaga

SEQ ID NO: 4199909 - RNA, 64 nt, Human
ucucauuuagaaccccuuccaaccuguucaaauauaggucccuuagauguucugaagacugaga

SEQ ID NO: 4199910 - RNA, 76 nt, Human
ucucauuuauuucucccaaaacaauucucugagguauaaguuauauuacacauguuuugggauggggaaauugagg

SEQ ID NO: 4199911 - RNA, 79 nt, Human
ucucauuugauugacaaggaaacuauaccagaauccucgguuuaaauguucugguuuugguguacuuggcauuaugaga

SEQ ID NO: 4199912 - RNA, 75 nt, Human
ucuccaacccaguuucuuuauuuguuugagugcuguuacaaaguuuccugcagcaaggagaagcuggggaggugg

SEQ ID NO: 4199913 - RNA, 107 nt, Human
ucuccaagcagcaagugaugaugucugcauaaggacaguuaucugcaaugauaaauacuaaaaguuguaggucaaguccauugugcuaacuuuucuucugcugggga

SEQ ID NO: 4199914 - RNA, 58 nt, Human
ucuccaaggugguuauuugagauagaaagauuuaaucaggaaugaauacuuuuggaga

SEQ ID NO: 4199915 - RNA, 61 nt, Human
ucuccacagcuggcccccaagaggacccuuuccaaguccccagcugggggcccuguguaga

SEQ ID NO: 4199916 - RNA, 79 nt, Human
ucuccacauguccucagcuuccuuccuccgccuuugugcuguggaauaagaaaggaaauugagggacgcaugaaggaga

SEQ ID NO: 4199917 - RNA, 92 nt, Human
ucuccacauuucugagcaguuuuacuccuguguucuuuguuaauugguccugaaaaaugacacaauuuuagagcugaaagaaacuuuggaga

SEQ ID NO: 4199918 - RNA, 67 nt, Human
ucuccaccagcugcaccagcugcacccaguaggucuccucugccaggcuuggugcuagauguggaga

SEQ ID NO: 4199919 - RNA, 74 nt, Human
ucuccagaaaucugauaugauucacucauugauccaaauuuuuaaugugcuugaagccucagagaauucugaga

SEQ ID NO: 4199920 - RNA, 68 nt, Human
ucuccagagucacacugccuggguuuggauccugauucuaccacuccacugccagcgugacuuuggga

SEQ ID NO: 4199921 - RNA, 73 nt, Human
ucuccagaguccugacgcagcaaccauuacauucccaguaauggaaauguuaagucaguccgugcucuggaga

SEQ ID NO: 4199922 - RNA, 59 nt, Human
ucuccagagugcaggugccugugagcuugaagccggaggggcugagcaacuuucagaga

SEQ ID NO: 4199923 - RNA, 64 nt, Human
ucuccaggcacuaccuggguaagccagauucuggacaugaucuaccaggguggugaccuggaga

SEQ ID NO: 4199924 - RNA, 55 nt, Human
uccuagguguuaauagcguuagacuagcagcuaaauauuauguuaacagcuggga

SEQ ID NO: 4199925 - RNA, 85 nt, Human
uccuagucuaauauuaacauauuguguggcacuaggcaggucacuccuccucuuugacuauaguaguuaaaauguagacucagga

SEQ ID NO: 4199926 - RNA, 129 nt, Human
uccuaguggaaggguuguugugaagauuaguggaaaaccaaggccugccacacuguuuguaugccaugugcagcagugacuugcuuuguuuccccuuucugguucuaguguuuccuguuguaacuaggg

SEQ ID NO: 4199927 - RNA, 81 nt, Human
uccuauauuuagauuuugacaucccucagugccuggccuggcuggaucuggugcagguugcuggucugaucucguauagga

SEQ ID NO: 4199928 - RNA, 130 nt, Human
uccuaucauacuaaaugcaucuuggaggcucaaaauaucuauuguccuaucuauuguaugagugaauguguaaaaugagcuuuaauuaggaaguauaaugaggacuuucgagaugaaugguagcauagga

SEQ ID NO: 4199929 - RNA, 104 nt, Human
uccuaucuuaugugaaaaaguuuugggccaugaaauauuaguaacuguuucaaaaacagaauagcuauauuucuguggucaaauaauuucauuauaucauagga

SEQ ID NO: 4199930 - RNA, 64 nt, Human
uccuauuacaguugggguaauuuaguuucaagguuuagaaauuugcuuuaacuaguaaaugggg

SEQ ID NO: 4199931 - RNA, 65 nt, Human
uccuauuucaguaaaacacugcaaugucugguguuucuaguaaugcauuuauuuuaugaaaagga

SEQ ID NO: 4199932 - RNA, 71 nt, Human
uccucacaagucucuuaauaaguaaauacugaugacauccucauuuuacagauaaagaugcugagugggga

SEQ ID NO: 4199933 - RNA, 85 nt, Human
uccucacaauuuguuuuaucaguauuugaaaaucuuaagaaaaaagcugagaaucugauagaagcaaguuuuuuuagugcaagga

SEQ ID NO: 4199934 - RNA, 66 nt, Human
uccucaccacaccgucggccuccucugucaacaccagcaacguaggaagcuaaguguggcugcgga

SEQ ID NO: 4199935 - RNA, 60 nt, Human
uccucacuccugcuguuggucucauuucuuccugucaaagaccuacauguauagugaggg

SEQ ID NO: 4199936 - RNA, 123 nt, Human
uccucacuuuguuugcuuuuauucucuguccucggguacccugaacugaccuaacuauacaccuuggggagaccagugaggaguccagggcagagaacaugguggcuugaaccagggagagga

SEQ ID NO: 4199937 - RNA, 69 nt, Human
uccucagagaaaugucacaacaaucuuaugcauuaggugcuauuguuagugccauuuuucauuugagga

SEQ ID NO: 4199938 - RNA, 76 nt, Human
uccucagcacaggcguguggucggcuuugagggcccgacugugcccaagagagaugagaacaugcuuggauggggg

SEQ ID NO: 4199939 - RNA, 60 nt, Human
uccucagcuccuaucucuguauggccugguuuuuccuagguuaugauuauagagcgagga

SEQ ID NO: 4199940 - RNA, 65 nt, Human
uccucaucucucugccugccacuguucaggcuccuggggccccacguggaugggcggacacagga

SEQ ID NO: 4199941 - RNA, 64 nt, Human
uccucauguaucuaagguacagugcuguuuaguugaacagcuuugcuucuggagacaaugggga

SEQ ID NO: 4199942 - RNA, 76 nt, Human
uccucauuacuacaaugacaguguugggccagaugcucaccaagccucuuccugcacugacauuuugugauggcga

SEQ ID NO: 4199943 - RNA, 80 nt, Human
uccucauugcagauuuuucacauucagauauagacuugauucuuaaaucagugugucacaaaauaugaaagcugcaagga

SEQ ID NO: 4199944 - RNA, 55 nt, Human
uccuccacgauggcacaccugguggcuggucacuguggcugcaggcgauggagga

SEQ ID NO: 4199945 - RNA, 102 nt, Human
uccuccagcugauugauuuuucuaauuauguuugcuuuagauggauauuuaaaugcauuugcauucccugagcucacauggcaggauauggagguuggagga

SEQ ID NO: 4199946 - RNA, 88 nt, Human
uccuccaggucgcccacgguggccaaccuggcccugaacucgcaccaggugacgugcaggaucugguuggcgauguagcccuggauga

SEQ ID NO: 4199947 - RNA, 72 nt, Human
uccucccaucucagaggcaggaauaaagcuuaccuuguucagcaagcagaguacuggcucuuggguggagga

SEQ ID NO: 4199948 - RNA, 56 nt, Human
uccuccccaaagcccagccuggcuggggucacggucaaaugcuggcggugggggga

SEQ ID NO: 4199949 - RNA, 105 nt, Human
uccuccccaagaggcccuaucuuucuauaccaguauguaguuucucugaugagaucagcauggaagccaguugcuuggugugguccaggaaggcuucugagagga

SEQ ID NO: 4199950 - RNA, 57 nt, Human
uccuccccucagggcaacggauggcugcagucuugccuauuuggccuguggggaggg

SEQ ID NO: 4199951 - RNA, 65 nt, Human
uccucccucucagccugcaggaaacagcucugacuugcugacugucugccagcugaagaggugga

SEQ ID NO: 4199952 - RNA, 61 nt, Human
uccucccuucucacugggaagggcugccugagauguuuccuuccuucugaggugaggagga

SEQ ID NO: 4199953 - RNA, 100 nt, Human
uccucccuucucgccagggcgccuucggccucucuuugaggccuuccccagggacucagagccucgagggacugcgggcucccuugugggugggggagga

SEQ ID NO: 4199954 - RNA, 82 nt, Human
uccuccgcagcauaugucagugccccauaacaaggugcucaauaaaugcucuucagauugcacugagcaaguugugagugga

SEQ ID NO: 4199955 - RNA, 62 nt, Human
ucucucaucuuuccuaacucugccuaucauccguguggggcaagcaaggcaggguaaagaga

SEQ ID NO: 4199956 - RNA, 58 nt, Human
ucucuccacccaccauccagauucucuuuuucugggauauguuuagguguuggagaga

SEQ ID NO: 4199957 - RNA, 59 nt, Human
ucucuccagguauuacuaaguguuaacuguugaguagauggaagugaaaucugggaaga

SEQ ID NO: 4199958 - RNA, 58 nt, Human
ucucuccaguuagcaguuccuggggcauggcugcuccagcuguugcagcacugagaga

SEQ ID NO: 4199959 - RNA, 72 nt, Human
ucucuccuuuucuguucaacauacuuguggccacuuucccauuaguuaaagucugaaauagagaaagaaaga

SEQ ID NO: 4199960 - RNA, 95 nt, Human
ucucucgcucccuccuugcugccgcauucuucugccuucauccucuuccuuugcagguagaaagaucuguaggcaagagcuaaggggaggaaaga

SEQ ID NO: 4199961 - RNA, 55 nt, Human
ucucucgguacagcuggcuggaagauccuuuuccagccugaacuuuguccagaga

SEQ ID NO: 4199962 - RNA, 101 nt, Human
ucucucucucucucucucucucugucucugucucauuagcucucauuucuucucuugcaaagcugaagauccaggguuggggagagaggaugugggacaga

SEQ ID NO: 4199963 - RNA, 108 nt, Human
ucucucugccgcccaggcuggagugcaguggcgcgaucucggcucacugcaagcucugcgucccggguucacgccauucuucugcuucagccucccgaguagcugaga

SEQ ID NO: 4199964 - RNA, 75 nt, Human
ucucucuuccuugccuuuaaccccugaaaggcuucacuuugcggccacaggcacuuaagggcugggaggcaggga

SEQ ID NO: 4199965 - RNA, 55 nt, Human
ucucucuuuuuaaucauguaaugugcuauaaagcaugauauauugacaagaggga

SEQ ID NO: 4199966 - RNA, 67 nt, Human
ucucugacccagauggcaccguggcuacuugacagccccgagccacuuugaaccacugagguggagg

SEQ ID NO: 4199967 - RNA, 64 nt, Human
ucucugagaauaucccauaagagcccuugaugcagaggccauauggcaugguacuuccagcaga

SEQ ID NO: 4199968 - RNA, 65 nt, Human
ucucugaggaagaggcuguaauuugcaugcuuaaucucaugucuauuccacuuuuccuucaggga

SEQ ID NO: 4199969 - RNA, 129 nt, Human
ucucugaguaggugcaugaaucuguguucugagaacaaguuagggucuuuuacuuaauuauaacagaugcaagaggugaugugcucuaacuuguaguacagcauaaagacaguaugauggaaucaggga

SEQ ID NO: 4199970 - RNA, 82 nt, Human
ucucugauguagaacucuugcagugaaagcuuaucuuuggaagaaacugggcugucuuucuggaagagucuuuucucagaga

SEQ ID NO: 4199971 - RNA, 71 nt, Human
ucucugcaacuacaucuuagggcugcuguaaguacuugcuuuuugccuuuccuauagguguccugcagaga

SEQ ID NO: 4199972 - RNA, 75 nt, Human
ucucugcagaggcagggugggaaccuucccgcagacacaucugcagagccucccuccucugccauucuggggaga

SEQ ID NO: 4199973 - RNA, 60 nt, Human
ucucugcccggggaauggcucuggcacugauccagaggccaucugcucuguggggaggga

SEQ ID NO: 4199974 - RNA, 71 nt, Human
ucucugcucagcugguuggaagggagcugaauagucauuuaggugcucguugcgacaggcugggguugaga

SEQ ID NO: 4199975 - RNA, 75 nt, Human
ucucuggaauuucaucuugauucuauauggccugggugcugcagccuccuaccuggucucuagaguuuucagagg

SEQ ID NO: 4199976 - RNA, 57 nt, Human
ucucuggagcugcagauccagguguucguuaccgcccggauguggcagcucuaguga

SEQ ID NO: 4199977 - RNA, 81 nt, Human
ucucuggcaguucuggucgauccuacugaguguguucucuggccagagaacacaugcagacuggguagagcugucugcagg

SEQ ID NO: 4199978 - RNA, 64 nt, Human
uccugagcuuuacaguaaggacauucauggcauuucccaagaggccuugccaguagggcuggga

SEQ ID NO: 4199979 - RNA, 106 nt, Human
uccugagcuuugauccuugguaaaggcuucugcagggacugagggagacaaagagaagaauccaucucgaucccuagccucaaggaauugacaaucuaauaaagga

SEQ ID NO: 4199980 - RNA, 64 nt, Human
uccugaggguagguccaucugggauaccaaauugcagaucacugguuacuuaaugaacuuagga

SEQ ID NO: 4199981 - RNA, 85 nt, Human
uccugagugugaaagaacuuguaaacuguuaaaagccagaauuaauaaguuauuuuggcacaauuuaccgguuuaaaguucagga

SEQ ID NO: 4199982 - RNA, 63 nt, Human
uccugaucucuucauagauuuaauaauuuucauccaaggaugaaggucuguaaagugacagga

SEQ ID NO: 4199983 - RNA, 72 nt, Human
uccugaucugacuucacgcccaugccacagaacuguccccacugcuuuauguggugcgugagcucggcagga

SEQ ID NO: 4199984 - RNA, 100 nt, Human
uccugauuauuuccuuuguguuaucguacgcuucagaaauuuccauuggagaguguuauuugggaauuucugggugagaagcauaaaugauuaaagugga

SEQ ID NO: 4199985 - RNA, 67 nt, Human
uccugauucaagaagaaguuguuaucagcccauaugaaacugguuuugacuuuauauugugucagga

SEQ ID NO: 4199986 - RNA, 65 nt, Human
uccugcagagucccacugauuugggccaacagugcuguauuugccuauccuugggaaauucaggg

SEQ ID NO: 4199987 - RNA, 57 nt, Human
uccugcagagucccuuuguucaguuggugaccaacauccugaaaaacauucucagga

SEQ ID NO: 4199988 - RNA, 61 nt, Human
uccugcagcagcuggugaccuugaaugagggcaucgaggcagugcgcuggcuguuggagga

SEQ ID NO: 4199989 - RNA, 111 nt, Human
uccugcagugccuggcaggccgaggcauccugggccaggucugugucagcugggacacucugcacauggcgcugguccugacugugccagugccuucuggguucugcaggg

SEQ ID NO: 4199990 - RNA, 96 nt, Human
uccugccaauggcgagggagagccuagagaaggcucagacuuacccagagcucaugaaacuuuugagguucuuccauacuucugccauggagagga

SEQ ID NO: 4199991 - RNA, 75 nt, Human
uccugcccacuauguggggacaacgugcugcucuucccucggaaagaugcugccucuccucacaagucgguugga

SEQ ID NO: 4199992 - RNA, 93 nt, Human
uccugcccacucccucccucucuugggcguggcucaguauuuaucuucauucccuggagcugaguugguuggagggagaggggugcuguagga

SEQ ID NO: 4199993 - RNA, 69 nt, Human
uccugcccgccgcugagccucugcggccugcagagcaccugggccgaagacgcugggcgugggccaggg

SEQ ID NO: 4199994 - RNA, 107 nt, Human
uccugccuaggaaagccuuaguguugggagggacccugaugacugaggagccugguagcuccaggucgcccacacuuucaggucucuugcaccagaagguggcagga

SEQ ID NO: 4199995 - RNA, 78 nt, Human
uccugccucuagguggcagccuuggcucuguaaaacccaggucuguuuuuggugcccugguucccacccuuggcuggg

SEQ ID NO: 4199996 - RNA, 56 nt, Human
uccugccuuagagcaaggaaaauucuuuuguucaucuuugaaaacuacaggcagga

SEQ ID NO: 4199997 - RNA, 78 nt, Human
uccugcuacugccauugucucugccaucucaggaaaggagcugagaaguggauucuaaagauagugacaguuccaaga

SEQ ID NO: 4199998 - RNA, 76 nt, Human
uccugcuaguugggugggagcaggcaggggcagcacucagaccuggugaccccuaaacccgcugggcuggcuagga

SEQ ID NO: 4199999 - RNA, 64 nt, Human
uccugcugcucuugggaaaccugcaaccacugccacaggaaugagcccagguuagccugcgggg

SEQ ID NO: 4200000 - RNA, 55 nt, Human
uccugcuggaaacuuccucuugccaagauccacuugggaaauuuccauuccagga

SEQ ID NO: 4200001 - RNA, 75 nt, Human
uccugcugggagccguaccugucacggggaagccacggcaagcagcucccgugaagguuugguuucugcuaaggg

SEQ ID NO: 4200002 - RNA, 76 nt, Human
uccugcuguaccuuucaacgugacacauuuaccuaacauccaaauucgaguaagugaggcaaagugagaggcagga

SEQ ID NO: 4200003 - RNA, 66 nt, Human
uccugcuguuuucuggcccacaaauuuggccuuucuacuacccagcacuggccacaaacaguagga

SEQ ID NO: 4200004 - RNA, 57 nt, Human
uccugcuuguucuuugugcauucuugcuauuggauuccauuuagaaauuggcaugga

SEQ ID NO: 4200005 - RNA, 80 nt, Human
uccuggaaaauugacuaguauuaagugugaguaaaagguguccacuuuuuuuuaaguuuugauuuuaguuuugucuugga

SEQ ID NO: 4200006 - RNA, 77 nt, Human
uccuggacaugguuuugccaggugggccacaggcugccucugguggcccaaagcucagcugagcgaaggacauggga

SEQ ID NO: 4200007 - RNA, 55 nt, Human
uccuggagaauggacaaugcaccgaugguaugguuucaaauucacuucuccagga

SEQ ID NO: 4200008 - RNA, 56 nt, Human
uccuggagcucacugggagccgguucucuucacagagcagccccaugguucuagga

SEQ ID NO: 4200009 - RNA, 91 nt, Human
uccuggagcucugggcuucuauagcugucugggacagggaagcuuucugggucucuguggcccaagugauggcugcgugguccguccagga

SEQ ID NO: 4200010 - RNA, 55 nt, Human
uccuggaggagauccaaucugagcuuagcuuagccuguguggacauuuucuagga

SEQ ID NO: 4200011 - RNA, 75 nt, Human
uccuggaggcagagcgcaugcgucgcagaaccgaaacguuuccgugaacaaguugcuugcuuucuguuucccgga

SEQ ID NO: 4200012 - RNA, 68 nt, Human
uccuggaggggagcucucagcugucuuuguaugcugcagcauacagugcgggugcgggccucuuagga

SEQ ID NO: 4200013 - RNA, 72 nt, Human
uccuggaggggccauccacagucuucuggguggcaaugaugcuguggacuguggucaugagucccucccuga

SEQ ID NO: 4200014 - RNA, 64 nt, Human
uccuggaguuuguaaggugagccaggaccaaggugccaggauucucauuuuguaagguccagga

SEQ ID NO: 4200015 - RNA, 69 nt, Human
uccuggauauuucaguguuuuaagaguucagugaaaauuuauuaacugaauaucuauuggaguccagga

SEQ ID NO: 4200016 - RNA, 58 nt, Human
uccuggauggccugcaggcggugucgcuucucacugagccagcggccgcccuccagga

SEQ ID NO: 4200017 - RNA, 97 nt, Human
uccuggcaagggaggacgagccaaggaccaguuuugcagaauugucaucaugaggcccugguugugugcugggcuggggcauugccccuuuccagga

SEQ ID NO: 4200018 - RNA, 64 nt, Human
uccuggcaauacucaacacuuuugcuugcuuccugcaggaauguauugaccuguugcauuagga

SEQ ID NO: 4200019 - RNA, 56 nt, Human
uccuggcagugcuuguuuuggagagauuccagggaugguaaugagcagugguagga

SEQ ID NO: 4200020 - RNA, 56 nt, Human
uccuggccaaguagauguggcgcuucaaucauccaggccugaaucugcagccagga

SEQ ID NO: 4200021 - RNA, 80 nt, Human
uccuggccaccugcagggggagucaagagugggagaaacuggcuccugcuccugcuccugcuugcaaggaaauaccggga

SEQ ID NO: 4200022 - RNA, 57 nt, Human
uccuggcccucugcaaacgccaucauguggggcgcagaguagcagagugcugaagga

SEQ ID NO: 4200023 - RNA, 56 nt, Human
uccuggccuuagcgaggcgguccgagggucaccuagagcuuugcacagagccggga

SEQ ID NO: 4200024 - RNA, 64 nt, Human
uccuggcuccugaucugucacugucccaccagcuugagggguaguguuuagguaguaguuagga

SEQ ID NO: 4200025 - RNA, 73 nt, Human
uccuggcugaggguuggacaggcaaguguaggacgagcuugaauuuccugccacugccgaccacagccaugga

SEQ ID NO: 4200026 - RNA, 55 nt, Human
uccugggaaguugcaucaccguagucaauaugcugcugugaccagagacccagga

SEQ ID NO: 4200027 - RNA, 55 nt, Human
uccugggcacuguggugcugacccuggaaugaaucagauccgagugugccaagga

SEQ ID NO: 4200028 - RNA, 87 nt, Human
uccugggccaaauauugcaugaggauuugggcaauguuuuggcuaguugaacaacaacaaugcucauauuuaugccaauuggcagga

SEQ ID NO: 4200029 - RNA, 70 nt, Human
uccugggcgguuaugugaucuggugugggaauuuuguggaccacuuuuucacauacagcaggccuaagga

SEQ ID NO: 4200030 - RNA, 111 nt, Human
uccuggggaguucuucaugccuuccggcugccagcccaccuuggggccuccacguucagauuugggagaggccucagugagggcugggagggaggaagaggaugcccaggg

SEQ ID NO: 4200031 - RNA, 61 nt, Human
ucuggcccucagacucaugggcacauucagaagucuugccuacugagacuggguggccagg

SEQ ID NO: 4200032 - RNA, 60 nt, Human
ucuggcccuggguggaaugucccauuuccuucaucacugagugggcuuccccagggcaga

SEQ ID NO: 4200033 - RNA, 63 nt, Human
ucuggccucaggcgagcugcaacuuggaucccuacugacucagcugaagcagccugggcugga

SEQ ID NO: 4200034 - RNA, 76 nt, Human
ucuggccucagucucccuccuauaaaauggggguaaaucaguaccuuucucagaggguggcugggagcaucacagg

SEQ ID NO: 4200035 - RNA, 62 nt, Human
ucuggcgccggcgggcagauggguaugcuggccaguccugucagccugccagcuggcccaga

SEQ ID NO: 4200036 - RNA, 58 nt, Human
ucuggcucauacaagccugcaaagguuuguucaauauucaggcauuuugugaaccaga

SEQ ID NO: 4200037 - RNA, 73 nt, Human
ucuggcuccugcagccguccuguuugucuacacccuucaccccaguggggaaauuguggcugacagugucaga

SEQ ID NO: 4200038 - RNA, 82 nt, Human
ucuggcucucucuuuaaagacuguuguuauugaauuuugaucaccaacagugguagcaaggacaacauaugagagagauaga

SEQ ID NO: 4200039 - RNA, 67 nt, Human
ucuggcugcuggaguugggucucuccucauguuugggcgacugagggcucaacuacuacuaggcaga

SEQ ID NO: 4200040 - RNA, 58 nt, Human
ucuggcuggggaagucauuugaugcccuugaggguaagcaaugugggccccagugagg

SEQ ID NO: 4200041 - RNA, 55 nt, Human
ucuggcuguguaagguagcaccaugugaauuccaggucuccuacccucagcuaga

SEQ ID NO: 4200042 - RNA, 62 nt, Human
ucuggcuucuccucugaguccugggagaccacgucuucccugaagcagggagaguagccaga

SEQ ID NO: 4200043 - RNA, 87 nt, Human
ucugggaaagccagguauuuguuauuugagagugcggcugcuggaggugcaguuuacucccacugaauagaagcugagggccccaga

SEQ ID NO: 4200044 - RNA, 65 nt, Human
ucugggaaaugggcagcuucgccuuggcugagccuggucagaggggcaugccuaccuuuccuuga

SEQ ID NO: 4200045 - RNA, 66 nt, Human
ucugggaagacggauggacccuaaagagcuagcugcaaacuaagugagucacauuugucucccagg

SEQ ID NO: 4200046 - RNA, 58 nt, Human
ucugggaguuagaauacaugggucaaaauaauaagacccguguaugguuagcucuaga

SEQ ID NO: 4200047 - RNA, 58 nt, Human
ucugggaugagaucagagacacggaguccaccugugccugcugccuuucaucccaaga

SEQ ID NO: 4200048 - RNA, 61 nt, Human
ucugggccaacccuuccaugggugaagacaagcaagucccccuggaggcggguggcccaga

SEQ ID NO: 4200049 - RNA, 62 nt, Human
ucugggccuccucugcccaagcuacuuagagggaugacagcaggggaaggggaggauucaga

SEQ ID NO: 4200050 - RNA, 61 nt, Human
ucugggcgugucuuccagcuggcugugggcugcauugccaguccaguaagauauggccaga

SEQ ID NO: 4200051 - RNA, 58 nt, Human
ucugggcugcugugcagugaccauuaucaaguaugaucauagcuuacugcagccuuga

SEQ ID NO: 4200052 - RNA, 61 nt, Human
ucugggcuuggaacccagggcuguguacuuaagcuuccagugacagguuccaugccgcaga

SEQ ID NO: 4200053 - RNA, 63 nt, Human
ucuggggaugagugaugucguaugguuugcuucucugccagcacugauagauucuuccccaga

SEQ ID NO: 4200054 - RNA, 80 nt, Human
ucuggggauuucaccucagucuuuuuauauggcuucuguaccaugcuguacaaauacauucugaagguagggucuccaga

SEQ ID NO: 4200055 - RNA, 97 nt, Human
ucuggggcaaauggagugccuguggcagugggccuggcacacucauuuacagcuaaacgcaguggcccauugcacaggcucaaagcucagcucuaga

SEQ ID NO: 4200056 - RNA, 72 nt, Human
ucuggggccagguguaggacaccaagggacauacugguauccucugcucugucuuuauaucuauaccccuga

SEQ ID NO: 4200057 - RNA, 67 nt, Human
ucuggggcuuuaucugagaugcacuggaugauugcaggcauauauuucugcucagcugaaccccaga

SEQ ID NO: 4200058 - RNA, 128 nt, Human
ucugggggaguggggggagccugcccggggcugugggggagccugcccggggcugugggggagccugcccggggcuguggggggagccugcccggggcugugggggaggcugcucuucacucucagga

SEQ ID NO: 4200059 - RNA, 61 nt, Human
ucugggguagggagggaguacuguagccaugguuuuacucacaguaaauucccugcaaaga

SEQ ID NO: 4200060 - RNA, 56 nt, Human
ucugggguugagucugggucagagucugcagagacugacaaggaagcaagcccagg

SEQ ID NO: 4200061 - RNA, 63 nt, Human
ucugggguuuaaagaguaacgacauuuaucucugaaaguugauggcgucuuugagauuucaga

SEQ ID NO: 4200062 - RNA, 63 nt, Human
ucuggguaugaccuauuuuuccagacuaaagcugcaacuagauggaaaaaugcaugcucaaga

SEQ ID NO: 4200063 - RNA, 77 nt, Human
ucugggucuaauuauuguccuguguaauucaaugggaauucucacagugaauuacauagacgugaauccagcccaga

SEQ ID NO: 4200064 - RNA, 65 nt, Human
ucuggguggguccuaaaugcagucacauguauccuuauaagagugaggcagagggauuuuacaga

SEQ ID NO: 4200065 - RNA, 59 nt, Human
ucugguaauaggcaauagcuugccaagaacuucuggccaggcugaauuguccuaccaga

SEQ ID NO: 4200066 - RNA, 63 nt, Human
ucugguacauuugaugauaauagguagccaaauauauuuguuaaugauccaaauuguaucggg

SEQ ID NO: 4200067 - RNA, 59 nt, Human
ucuggucaacagaaacucuuugugauuucaaaagucagaaagugaacuguugacaugga

SEQ ID NO: 4200068 - RNA, 107 nt, Human
ucugguccaagguuacagggagucagugaaggagucagaaucacuaccuguggccucuaacuccugucugcugcuauuccacuucuuggugcugguuugggaccaga

SEQ ID NO: 4200069 - RNA, 64 nt, Human
ucuggucucuuguggguggcagaugacagacaaucugguaucuguucaauggaagaugacgaga

SEQ ID NO: 4200070 - RNA, 116 nt, Human
ucuggugaguucagcacggacacuguugcuggcacagacagggcagcuuuucccaugagccacaaacauugacugcugucccuaaagcaacugucacugccccugcccuugccaga

SEQ ID NO: 4200071 - RNA, 64 nt, Human
ucucucuuggccagacacagaggcauccuguguugauggcugccuuucuuauggccaaggaagg

SEQ ID NO: 4200072 - RNA, 61 nt, Human
ucucucuuggccucucuuuggagagcagaggcggaaagcaggcuuagaggccacagacaga

SEQ ID NO: 4200073 - RNA, 84 nt, Human
ucucugacuuuauaugguugcuuguuuauuuacgaucugccaccaacuagaguguaauaagggcaagggcuuuguugucagaga

SEQ ID NO: 4200074 - RNA, 60 nt, Human
ucucugagguuuccucacaagcuguugaguuagaagcagccuucaggcaaugucaguaga

SEQ ID NO: 4200075 - RNA, 66 nt, Human
ucucugauguuugcugacuuuuuagccaaaaagaaagagaacauuugguuaacacaggcucagaga

SEQ ID NO: 4200076 - RNA, 77 nt, Human
ucucugauucuccuggauccccuuuuacuuagaggaaccuuuauaaguacauuugggaccaccuggauaaucugaga

SEQ ID NO: 4200077 - RNA, 65 nt, Human
ucucugcaauaacuacuuuaauguugguuuuccccacaacgcuagcagcugcaggaaggcagaga

SEQ ID NO: 4200078 - RNA, 68 nt, Human
ucucugcagaaaauggaguucuaaguauaguaacaauuuaguuacauaguuacuuccauuuccagaga

SEQ ID NO: 4200079 - RNA, 70 nt, Human
ucucugcaggccuugagugugguauaacagaacauaaaguacugaccacgcuuucaaaggguugcaaaga

SEQ ID NO: 4200080 - RNA, 58 nt, Human
ucucugcccauccucaguccacugcacccacccuuugcugugucaggaugugcagggg

SEQ ID NO: 4200081 - RNA, 84 nt, Human
ucucugccuuccacuccacuggacuugaaucccuugguccaugagaccaggaaacucucgucuaguuuagucuggcggcagggg

SEQ ID NO: 4200082 - RNA, 98 nt, Human
ucucugcuggcugucaacaggugauuggugggcugaggggcagcacuguagcgaguccauacaguccacacggugcagcugaggacaccaggaguaga

SEQ ID NO: 4200083 - RNA, 77 nt, Human
ucucugcuguuuaagucaaccauugugugguauuuuugcuacagcagcauaaacugacuaagacaaugagcaugaga

SEQ ID NO: 4200084 - RNA, 64 nt, Human
ucucugcuuaucaaacuggagcaggcuuugcauugaauaaagcuugcaauaaaugauacagaga

SEQ ID NO: 4200085 - RNA, 80 nt, Human
ucucugcuuucuaaggcagccucaggguagggucuggagccucugcucucagguagccuccuaucagagcugagcagaga

SEQ ID NO: 4200086 - RNA, 76 nt, Human
ucucuggcagaggcaauggaaugggcacucgguuuggagucuggcgcugccuccaccauugcucacuuugcaguga

SEQ ID NO: 4200087 - RNA, 85 nt, Human
ucucuggccugauacauaguaggggcucaguaaauacuuuuauacugagcugacaucuuccucuuuuuaugugguaguccuaaga

SEQ ID NO: 4200088 - RNA, 60 nt, Human
ucucuggggcucacuuuggucaggcgguagcuuagucgccuuucacaguggucccaggga

SEQ ID NO: 4200089 - RNA, 59 nt, Human
ucucugggugauggcagggcacccguggaugaugcagccuuggagaagucacucaggga

SEQ ID NO: 4200090 - RNA, 56 nt, Human
ucucuggguugagaacuaggaccauuuuccugguuacuguuucuacuacuuaggga

SEQ ID NO: 4200091 - RNA, 76 nt, Human
ucucugucagaaugggguaaauaaauuaggauuuggcuaaaucucugguuguuuugcucccauguuguggccuaga

SEQ ID NO: 4200092 - RNA, 89 nt, Human
ucucuguccuaauugagcacaugacuuuuagucgaguuccagaaauaugacacuugcacugagaucugugccacaaaaaggcucagaga

SEQ ID NO: 4200093 - RNA, 67 nt, Human
ucucugucugccugcaauccagagacuggcuaugacugcuugccagugucccacagggagacggggg

SEQ ID NO: 4200094 - RNA, 55 nt, Human
ucucugucuuuguugucuucacauugaguagggugaggagaggaggaagaggaga

SEQ ID NO: 4200095 - RNA, 62 nt, Human
ucucuucaauagauuguugagggacaaagcucuaucuaaaugucccuaucuaacugaagaga

SEQ ID NO: 4200096 - RNA, 99 nt, Human
ucucuucucugguucucuccuuccuuuguuugcccauaucaggauuauaggccaaggacaguaaggacaggacugaacaugcuuagagcaaacauggga

SEQ ID NO: 4200097 - RNA, 78 nt, Human
ucucuucuuuccugaucuuuccuccugugguggugaggugacuucucaaauauuuggagagaggaggucagaagcaga

SEQ ID NO: 4200098 - RNA, 66 nt, Human
ucucuugcugaauuuacauuuuuguagcccaugacuuggguagcauugguggaauuaggcaaagga

SEQ ID NO: 4200099 - RNA, 74 nt, Human
ucucuuggagguucuuccuguuucucuacuuaucucuuguuguuguuguaguucugcagaaaccuuuaggauga

SEQ ID NO: 4200100 - RNA, 69 nt, Human
ucucuuuaacucccauucuguccuuuuucauaaaagcagccagagggacacuguauaaguuagaguaga

SEQ ID NO: 4200101 - RNA, 67 nt, Human
ucucuuuacuuucaccaauuugcccugagacagacccagucaugaaaaguuugugacaguaaaggga

SEQ ID NO: 4200102 - RNA, 60 nt, Human
ucucuuuagugcuuagacgucuggucaauaaagacaaaccagaacaaguacuaaaggaga

SEQ ID NO: 4200103 - RNA, 98 nt, Human
ucucuuucuauguccaguuuuauaucuuccauugguugaagcuuuugcuggugaucagaugucagagauguggaauugucaacgagaaugggaggaga

SEQ ID NO: 4200104 - RNA, 115 nt, Human
ucucuuuuuuccccagggcagucauuaugauuaauucacaggaucacaggagaggaacuuuuaaguccauuuagguacauucuggaauguaagacuauccuguggaauaguggga

SEQ ID NO: 4200105 - RNA, 67 nt, Human
ucugaaacagcugagccacagcagcaaaagcaucagagcugggcaacugugguacagcugggacgga

SEQ ID NO: 4200106 - RNA, 68 nt, Human
ucugaaagcugcacuacuugagggaccaaggaaaauacuuggucuaucuccuggugcugugaaacaga

SEQ ID NO: 4200107 - RNA, 69 nt, Human
ucugaaaguacaaggaaaggaucugaugccguccucucuccuagcuucggguaguuccuuggcuuguga

SEQ ID NO: 4200108 - RNA, 74 nt, Human
ucuguuauuuggaggaugcuugguggucuguaaucuaaaaucugagacgauaaaggauuuuucaaaauaaucga

SEQ ID NO: 4200109 - RNA, 69 nt, Human
ucuguuccacagcacaaagccaguguggcuauuucauuuaguuucucaggccacagcucccuguacaga

SEQ ID NO: 4200110 - RNA, 86 nt, Human
ucuguuccccagucccugcuuuccucagcuggccugauugggggucuucccagaggggucgucugaggggagggugugggagcagg

SEQ ID NO: 4200111 - RNA, 64 nt, Human
ucuguuccuggaaugccguaugaagagguaggaacaggccaugaucagaaggcuccagagcaga

SEQ ID NO: 4200112 - RNA, 76 nt, Human
ucuguuccugugugugaaucugugugugugugugugugugcgcgcgcgcaugugcguugauugcagugggaaauga

SEQ ID NO: 4200113 - RNA, 65 nt, Human
ucuguucugaagguucugcacuuuauuauauaggugguagaaagcguuaaaucuacagaauauga

SEQ ID NO: 4200114 - RNA, 57 nt, Human
ucuguucugggccaggggacacuguauucugggguauccaguagggcccagagcuga

SEQ ID NO: 4200115 - RNA, 113 nt, Human
ucuguugcaaaccuaaagucaaaauuucuugaaugcuaagggccuuacaaagaugaauuggugcuucccugaaucuaaggcacucauucaaggagauaagcagugcacacagg

SEQ ID NO: 4200116 - RNA, 56 nt, Human
ucuguugcccuagccuagccauuacaauugcccaguggccuuucuugggcuacaga

SEQ ID NO: 4200117 - RNA, 70 nt, Human
ucuguuggcuggagguuucaccugaguuucacagggaaggccaggaggaacuuuuagucaaagcagcaga

SEQ ID NO: 4200118 - RNA, 63 nt, Human
ucuguuguccaggcuaaagugcaguggugcaauuauggcucacuguagccuugaccucccagg

SEQ ID NO: 4200119 - RNA, 95 nt, Human
ucuguuguccauguguggcuaggcgagggcugcagccagacccauggccuuaucugccugcagggcccgccugagcccucagugacagacacagg

SEQ ID NO: 4200120 - RNA, 100 nt, Human
ucuguuguccgaggccugggcccgcagcugcugcuccagcuucgugcggcucucauggaucucggcaaugcgggacuugagccgcucggaguucagcagg

SEQ ID NO: 4200121 - RNA, 107 nt, Human
ucuguuguuggccugugucuuucccucuuucauucuguccuuguuuggggccaccaaacuugaggcaaugaagguguagguugagaaauuacuugggcuaccaaaga

SEQ ID NO: 4200122 - RNA, 65 nt, Human
ucuguuuauagaccugggccuguuuugaaaaguagauaaucaaaaugaucccauuuagaaacaga

SEQ ID NO: 4200123 - RNA, 69 nt, Human
ucuguuuaugacggagcugguugcugcggcugccaggugcuggcagucggaagcugugcguaaaucagg

SEQ ID NO: 4200124 - RNA, 81 nt, Human
ucuguuugcaaagcauauauuuuugguuauuucuguuaagguuauuacuuagcagcaauuucagaaguuuguuuuaauaga

SEQ ID NO: 4200125 - RNA, 87 nt, Human
ucugagauuuugccuaggaacaagcuuuauucaugauuucagggauacaaauuaucaugagucauagugaagcaggagaaaucugga

SEQ ID NO: 4200126 - RNA, 81 nt, Human
ucugagcccugcacggugcuggguauugggguucuccugggaacuuagcugagccccacccuagacauucuggggcuggga

SEQ ID NO: 4200127 - RNA, 86 nt, Human
ucugagccuugaccacagcucccucucucacacagcuuccuucuuuggugagaaccaccuggaggugacuguggccauggcucuga

SEQ ID NO: 4200128 - RNA, 62 nt, Human
ucugagcgccucaagucucaugaugaagcaaaguuuuauuguuuagaagggggcugcuauga

SEQ ID NO: 4200129 - RNA, 75 nt, Human
ucugaggaaaugccccggcagccccugaacaggcuucaguagucccuucagugcuaggcugccugguuuuucaga

SEQ ID NO: 4200130 - RNA, 69 nt, Human
ucugaggaaguugcccagcugggccugaguuggggaacugggccugaguuugggaacugggaucucgga

SEQ ID NO: 4200131 - RNA, 58 nt, Human
ucugaggacagugcugugccuggccuuuccccuucaacacgccagcugcucccucaga

SEQ ID NO: 4200132 - RNA, 59 nt, Human
ucugaggccuaggcccuuucugagcccugaggccccucagcucagggccugggucugga

SEQ ID NO: 4200133 - RNA, 57 nt, Human
ucugagggaauagcuauuguagguaaggugaauaucucuaaguaggugacccucgga

SEQ ID NO: 4200134 - RNA, 88 nt, Human
ucugagggaccugccuuuucacccuggagcuuuucuggcccugagugacagauaccacagccuccagggaugcugcagguucuuugga

SEQ ID NO: 4200135 - RNA, 55 nt, Human
ucugagggaucagcuuggauacagagcucuccugggaucagcugaagccuucaga

SEQ ID NO: 4200136 - RNA, 72 nt, Human
ucugagggauuucugaauccacagcuggcuagauuuagacaaagaaacuguggaaucaucaggucuuacaga

SEQ ID NO: 4200137 - RNA, 55 nt, Human
ucugagggugggagaaggagcugagaaccagcuaccaggcccagagacccucgga

SEQ ID NO: 4200138 - RNA, 59 nt, Human
ucugaggucuaugacuuugcuucuuguuuuauaaagccucuuuaguccuagaucacaga

SEQ ID NO: 4200139 - RNA, 62 nt, Human
ucugagguggcagaugggggugcucgcccaugaaacuagaggggugugcccuguuacccaga

SEQ ID NO: 4200140 - RNA, 69 nt, Human
ucugaguaacagcuaugguacucaguugaggucguucuugcuacaugguuucaaagcuggaagcucaga

SEQ ID NO: 4200141 - RNA, 61 nt, Human
ucugaguccuuuucauagcagugggaaugcacauucccgacuuggcccaggggacaccaga

SEQ ID NO: 4200142 - RNA, 59 nt, Human
ucugaguggcagguuccguagacagcauuuucauggaauauugucaaucugcuuucaga

SEQ ID NO: 4200143 - RNA, 61 nt, Human
ucugauaaugugcuucgugaccuuauggucauuucaucauucagaagcuacaagagucgga

SEQ ID NO: 4200144 - RNA, 78 nt, Human
ucugauauuucauccucacagcuuuucaaaguggauauuggcauccucuuuuuagaguugaggcucagagaaauuagg

SEQ ID NO: 4200145 - RNA, 73 nt, Human
ucugaucacuguggaauuagaauaaccuuuugugaauaucagccuagagaguauucccuuucauggugacaga

SEQ ID NO: 4200146 - RNA, 64 nt, Human
ucugaugucaguuguagguugcagccagaauugauuugauuuugcaaaaugcaauugaguuaga

SEQ ID NO: 4200147 - RNA, 74 nt, Human
ucugauguguuuaagaaagaaguucaaaacugcuacucaaaguaguaaaauuauuucuuucuguuacauccaga

SEQ ID NO: 4200148 - RNA, 62 nt, Human
ucugauucaucuucaagucuccaggaucuaauacaguuccuggaacauaguagauggucaga

SEQ ID NO: 4200149 - RNA, 74 nt, Human
ucugauuggccaaacuggugucacugagggcugggaagauuauccccacccaagaacacacagggacagacaga

SEQ ID NO: 4200150 - RNA, 76 nt, Human
ucugauuggcuaugaggagcgcagguguauuaaacauuuucaguaagcuuuuuucuccucaauagcaaaaauuaga

SEQ ID NO: 4200151 - RNA, 70 nt, Human
ucugauuuauguauuagagcuccaugaggggccacugcuaguccacauggagcccuuugugcaagccaga

SEQ ID NO: 4200152 - RNA, 66 nt, Human
ucugauuucccacaauuaggugcauguauuuugugugcauguauauuuuauguggagagaagcaga

SEQ ID NO: 4200153 - RNA, 60 nt, Human
ucugauuucucaguucuaggaagcaggcuuaucugauuuccuaguuucuggcagauuaga

SEQ ID NO: 4200154 - RNA, 80 nt, Human
ucugcaaaccagcugccaugcucaagaagucuuuccuggaaaggcuucagugaguggguauuaagauugccauuugcgga

SEQ ID NO: 4200155 - RNA, 60 nt, Human
ucugcaaacuggcucuuacugcuuuccagagcccaaggucaaagguagccagccugcaga

SEQ ID NO: 4200156 - RNA, 66 nt, Human
ucugcaaucucauuguucccuggggacacagagugaguccaagagccagugggaaaacauugcaga

SEQ ID NO: 4200157 - RNA, 55 nt, Human
ucugcacacuuuuauugaccucugccagacccuggggucauagaagugaaucaga

SEQ ID NO: 4200158 - RNA, 61 nt, Human
ucugcacagauucucugagaauguauccagaacauaucuaguuacagagaauuaguacaga

SEQ ID NO: 4200159 - RNA, 70 nt, Human
ucugcacccagcacagccugcccagcccagcccugcccccgggcacugcacagccugucugggggccaga

SEQ ID NO: 4200160 - RNA, 78 nt, Human
ucugcagaccuugcuucuaguuuagggcucuucaacuuggaaggugggaaguagaaacuaggaagagagucucaacga

SEQ ID NO: 4200161 - RNA, 83 nt, Human
ucugcagagcccgcaucccaacccugacccaggggccggggcgcaggcuccuggagggaggcggugcuacgggacucugcgga

SEQ ID NO: 4200162 - RNA, 64 nt, Human
ucugcaggcuuggaguggcagccuuuuaaugguuuugcucaagcccggcucccgugccugcaga

SEQ ID NO: 4200163 - RNA, 56 nt, Human
ucugcagggucccagccucagcauccaaaucagaguuuagaagcugggcuugcaga

SEQ ID NO: 4200164 - RNA, 96 nt, Human
ucugcagguccgcuucaaagcccuggucugccacccacaccccuccaaauguggagaaugggggcuacaggccacaugcaguuguggaccugcgga

SEQ ID NO: 4200165 - RNA, 77 nt, Human
ucugcaggucugcuggagugugcuagaggucuacuccagacccuguuugccuggguaucaccagcagaagcugcaga

SEQ ID NO: 4200166 - RNA, 57 nt, Human
ucugcagguggauuaucagaagugcacaaaaauggcuguguagaucuggcacccagg

SEQ ID NO: 4200167 - RNA, 61 nt, Human
ucugcagguguuggaagggucagucaggaagacuuucucgagguguucagcccacugcaga

SEQ ID NO: 4200168 - RNA, 117 nt, Human
ucugcagucaaaucuacugauuucugccuccccugugucuuccucugcccaggccuggcccaggcuugguggggauaugggggguggaggagagaagaggccuagauuggcuccaga

SEQ ID NO: 4200169 - RNA, 75 nt, Human
ucugcagucaguuuucuuaaagggaagaucuagaaacaaagaaauaauagaauuuuccagaaucgacucuguaga

SEQ ID NO: 4200170 - RNA, 55 nt, Human
ucugcaucagaguuugcugcugcugcugcugcuagcaaagcuaucucuauggaga

SEQ ID NO: 4200171 - RNA, 69 nt, Human
ucugcaugaagccugcacauauuuuggggggaaaaccaaguaauccucuuugugccugcaggcugcaga

SEQ ID NO: 4200172 - RNA, 61 nt, Human
ucugcauggagaggagaugcuaauaguaaauaauuaaauuuagcacuucccaugucuuaga

SEQ ID NO: 4200173 - RNA, 60 nt, Human
ucugcauguggcugguggcuggagggauaugcacuucccaugccaugggcuggcagcaga

SEQ ID NO: 4200174 - RNA, 76 nt, Human
ucugcauuccuugaguucccugugcccugccccucgugaguguccagucccugccaggcaaauuaaggaaugcaga

SEQ ID NO: 4200175 - RNA, 83 nt, Human
ucugcauuuaagcauuuguguucuuccuagagcucagaaccaucaagagcugaugagagagacaaaugcuccuuaaaggcaga

SEQ ID NO: 4200176 - RNA, 87 nt, Human
ucugccaaucuguuagagcuuuucaaccuuuccuuguuuuuccuaacauugagaguuuugaagaguaugugucugguuuuugguaga

SEQ ID NO: 4200177 - RNA, 69 nt, Human
ucugccaccuggacaaccuuaugcaaguuacuuagcaacuugguaguaugagguguucagagugaagga

SEQ ID NO: 4200178 - RNA, 57 nt, Human
ucugccagcaccaugauccuucuuggaaaagaagcaaaaucugacugaugcuggaga

SEQ ID NO: 4200179 - RNA, 60 nt, Human
ucugccagugccucugcuuccucacugcugccgccugcucaggcagagcgcacuuuuaga

SEQ ID NO: 4200180 - RNA, 57 nt, Human
ucugccaguggauucuuauucuaggacccagaauaaggaagagagucuaaugggaga

SEQ ID NO: 4200181 - RNA, 86 nt, Human
ucugccaugcuggaggagcgcuuccgguagccggugggcuucacaccagauagacccugaaugcucucauuuuccaacauggcaga

SEQ ID NO: 4200182 - RNA, 64 nt, Human
ucugcccagccagacccaagguuuucagaacacuccuuagcguggacucugggucuggagcaga

SEQ ID NO: 4200183 - RNA, 72 nt, Human
ucugccgugcgaggucccaccacaacaaucccggggccagggugcugcgcuugguggggccugagaggcggg

SEQ ID NO: 4200184 - RNA, 85 nt, Human
ucugccuagcugaagugucuuuuagccacuuuuauacaaauaaguaauguauacuuagaauacuugggacacuucacuggguuga

SEQ ID NO: 4200185 - RNA, 60 nt, Human
ucuucccccgugcuccagugcagcggguacucguggcccugccggggcccugggggaagg

SEQ ID NO: 4200186 - RNA, 73 nt, Human
ucuucccucaacaacuucccuauccacccacccuccaccgccaccguggacuauaagucacuugagggcagga

SEQ ID NO: 4200187 - RNA, 112 nt, Human
ucuuccgggcuuaguuuaauuccucuuguguuucuccucaaucucaccuuacccuucuuuguaacuugggacagguuggagagaagcaggcagauaaacuuucccuagaaga

SEQ ID NO: 4200188 - RNA, 57 nt, Human
ucagcauccucuugauaacugcauacuucuuuuuaugcuugucuucaggaaugcuga

SEQ ID NO: 4200189 - RNA, 84 nt, Human
ucagcauccuggaaagucuuugcaauuuauguggaauuucucauguggagcucuacacauuuguaaaggcauuuguaguccuga

SEQ ID NO: 4200190 - RNA, 75 nt, Human
ucagcaucugggauggcuccgcugcugcugagugguaucuuucugaguggcuagcaggcuagcccagagaucuga

SEQ ID NO: 4200191 - RNA, 128 nt, Human
ucagcauugaguaaaagguuuggauagugagaaguuugaaagaccaauuagauuuuacuucugugagagcuggaaaaguuguuuuaaucugccuuacuuuaacguuucccauuccucaccaaaacuga

SEQ ID NO: 4200192 - RNA, 58 nt, Human
ucagcauuggagaggagggccggaggccccuauugacaauucucuucuccagagcugg

SEQ ID NO: 4200193 - RNA, 67 nt, Human
ucagccaaauguauucucacuucagggaugcaagaacaggccuugcaggugcaguacagccagcuga

SEQ ID NO: 4200194 - RNA, 63 nt, Human
ucagccacaccacuuccuuauggcucucggucuccuuagcagccguauuauggugguuucuga

SEQ ID NO: 4200195 - RNA, 130 nt, Human
ucagccaggcccuccgccuugcugccagggcugcgggcuccucaaggucucaggaauaacagggccccugugccugucuccucugcagggugaggcccucagcccagaggguguggacuggccugguggg

SEQ ID NO: 4200196 - RNA, 62 nt, Human
ucagccaguugccccaguuaguugaagcugcaguagaggauuaguggguguugcauggcuga

SEQ ID NO: 4200197 - RNA, 84 nt, Human
ucagccccuaaaagaaaucaagucacuguuaaaugguggaguauacauucuguuagugagugacuugacacuugugaggguuga

SEQ ID NO: 4200198 - RNA, 63 nt, Human
ucagcccugaggacagaggcagccugcauuccagucccagcucuucucugucucgguguguga

SEQ ID NO: 4200199 - RNA, 56 nt, Human
ucagcccuggcacugucucccauucucagaggagacagggcagagccagaggcuga

SEQ ID NO: 4200200 - RNA, 71 nt, Human
ucagccucucaaagugcuaggauuauaggugggaggcaccacaccucgcccagcaacuuuuaaaggucuga

SEQ ID NO: 4200201 - RNA, 83 nt, Human
ucagccuuagucaacaaguguauuaauggaaauacuauggcucaguauguuccacauugguaaacuugacagaaauagccuga

SEQ ID NO: 4200202 - RNA, 60 nt, Human
ucagccuucccagucaccaggacuacagccacauuccacugugccuggcugggaaucuga

SEQ ID NO: 4200203 - RNA, 66 nt, Human
ucagccuuguggcccugcuccagauauuuccucuugaggccaaucacagggaccacaaaaagcuga

SEQ ID NO: 4200204 - RNA, 70 nt, Human
ucagcuaccacaggacacaacugcugaccucccgccaaagggaggcuggaacauuuuuguccuugucuga

SEQ ID NO: 4200205 - RNA, 111 nt, Human
ucagcuacuguagauugguacauuacucacugacugcaagucaaguuaaacuugaaagccuggauuuaacuuaacuuggucaugauauauugucuuuuauacaauuguugg

SEQ ID NO: 4200206 - RNA, 56 nt, Human
ucagcucccaggaacuaagaaucaugauuugaaauauaaggacuccugggaguugg

SEQ ID NO: 4200207 - RNA, 75 nt, Human
ucagcucgagcggcgugaaccugcagagcauggauucguccacgucuccuugcugcaguucacccugccgucuga

SEQ ID NO: 4200208 - RNA, 79 nt, Human
ucagcugcaggucagcuaggcagcugcgauggccuugggauccacuggcaguuggcuagccuucauugaccucagcugg

SEQ ID NO: 4200209 - RNA, 87 nt, Human
ucagcugccugguugggaagcaguaugucugugcucaagagagugagcucuuaaggccaauuacauauguucacauuccaggccuga

SEQ ID NO: 4200210 - RNA, 55 nt, Human
ucagcugcuucauguucugaauucuaaugaauuugaaacuauacugagcagguga

SEQ ID NO: 4200211 - RNA, 58 nt, Human
ucagcuggaagauggugcagaauccuaagguaggguccucugcagugcuuccagguga

SEQ ID NO: 4200212 - RNA, 61 nt, Human
ucagcugggggccuuacggaacuccagggugcuggaggccccguuggucuccauuugcagg

SEQ ID NO: 4200213 - RNA, 87 nt, Human
ucagcugugucaaaugcugcugaugugauagguugcuagaucaauaacagaauugccuauuauauuuaguaauguggaguuaguugg

SEQ ID NO: 4200214 - RNA, 60 nt, Human
ucagcuuucucucgccaucagguggaucucuugauaugacuugcuggugggugaggguga

SEQ ID NO: 4200215 - RNA, 68 nt, Human
ucagcuuuggagagaguuaaauauguuagugaaaucagaacaaauuuucaaguucuccacugaccuga

SEQ ID NO: 4200216 - RNA, 62 nt, Human
ucaggaaagccuagaagagaacacauagcaccagacacauugugucaucuuucuuucacugg

SEQ ID NO: 4200217 - RNA, 90 nt, Human
ucaggaagaaagacagaaguggugggagauugucguggguuccaguucaucaucauucucccccacuucacauccaucuuuuuuuccuga

SEQ ID NO: 4200218 - RNA, 57 nt, Human
ucaggaagacaaucuuuggcucagucagcugggcugaaguagccagguuuucccuga

SEQ ID NO: 4200219 - RNA, 57 nt, Human
ucaggaaggcucuggccuuagagacacagacacagcugugggcagagcaccaccugg

SEQ ID NO: 4200220 - RNA, 86 nt, Human
ucaggaauagauaaaaggcauucaucaggcagccaggcccaauuaucaugucacgcugaaugaauguauuuuaaaaucuuuucuga

SEQ ID NO: 4200221 - RNA, 74 nt, Human
ucaggaaugcaggcagacuuugagaaugauguaucuuugcuuacucuucuugacagguuuccuauuauucaugg

SEQ ID NO: 4200222 - RNA, 63 nt, Human
ucaggacaacauguugcuaaucugagcaaaaaguucauuuaccaaguagcaauguucuuguga

SEQ ID NO: 4200223 - RNA, 67 nt, Human
ucaggagaaggcaauguggaaaugaaugcuuaagagaaguaccuguugcaucaauuccuuguccuga

SEQ ID NO: 4200224 - RNA, 63 nt, Human
ucaggagagaguuggguaggcuuccacagcacauuccagccuccucauuucucaucucccuga

SEQ ID NO: 4200225 - RNA, 70 nt, Human
ucaggagcagggggaagcucugucuucacugauugauuuuucugagaagugaguuccccauuucuccugg

SEQ ID NO: 4200226 - RNA, 69 nt, Human
ucaggagcuuagaugcuuugaccuuuuauuuacucuguccuuugggcuaauugucaucauggcucuuga

SEQ ID NO: 4200227 - RNA, 55 nt, Human
ucaggaggagcucauaaguuuggcuuugcagauguugagguuuaggcucucuuga

SEQ ID NO: 4200228 - RNA, 55 nt, Human
ucaggaggcaaguagguauugacaguucccaaggucaaacuuccuggccuccuga

SEQ ID NO: 4200229 - RNA, 59 nt, Human
ucaggaugaagucagaggggucaguaguuccugagcugaccuuuuuaaacaaauccuga

SEQ ID NO: 4200230 - RNA, 72 nt, Human
ucaggaugggucugagggccuuaccacuccuguacccaccaacccaggacugguacuucaagaccccacugg

SEQ ID NO: 4200231 - RNA, 106 nt, Human
ucaggauucugcuuggagcaugugucguagggaugcagcaguucagaagucaauaaaccucagugagcucauagcucuuauuauguacaaaaucuaacagcccuga

SEQ ID NO: 4200232 - RNA, 64 nt, Human
ucaggauuucaacuuuaugcauauguauuuuuaauuaaaguauaauugcauggaauuggauuga

SEQ ID NO: 4200233 - RNA, 58 nt, Human
ucaggcaaucugacagcuggagccaaugggaaauggguagcaugucagaggagccuga

SEQ ID NO: 4200234 - RNA, 58 nt, Human
ucaggcacuuggaggaguuggguauggggagaaauacagagcaccugugagagccugg

SEQ ID NO: 4200235 - RNA, 58 nt, Human
ucaggcagaccaccgugggcagcucugauauggauacgugcacacuggauugcucuga

SEQ ID NO: 4200236 - RNA, 89 nt, Human
ucaggcagccuuaucugucauccuagaacuccaggacagucccacauuguguugggaguggccacgacugggagauggaucugcucuga

SEQ ID NO: 4200237 - RNA, 55 nt, Human
ucaggccacggcucacugagacagcccagauugucuugcugauuagccugcuuga

SEQ ID NO: 4200238 - RNA, 62 nt, Human
ucaggcccauuuguagccacuuugcauccuagucuauugcaguuggcuuccugagggucugg

SEQ ID NO: 4200239 - RNA, 58 nt, Human
ucaggccgcccugggcuguggucauccucgcugugacagcaagccaaauguggcccga

SEQ ID NO: 4200240 - RNA, 69 nt, Human
ucaggccucuggagguggcaguguccccacagucccgcagaaaaacacagagacacuuuugaggcugga

SEQ ID NO: 4200241 - RNA, 58 nt, Human
ucaggcuagacuuuggcgaagcacagcacccuggggcugagccugaagguuagcuuga

SEQ ID NO: 4200242 - RNA, 55 nt, Human
ucaggcugaccagguuuugcucugcaauuauguuuaccaggaguuggcagucuga

SEQ ID NO: 4200243 - RNA, 77 nt, Human
ucaggcuguggcuguguggcugcucuggaccuggaguggaugguguggugucagggcuggacacagcugcagccugg

SEQ ID NO: 4200244 - RNA, 64 nt, Human
ucaggcuuccagaggaacucugcagugcgugacgaacguauuguugcauccucugaagagcuga

SEQ ID NO: 4200245 - RNA, 60 nt, Human
ucaggcuuccaggcucugcugaccacaaguucugcugccagcaaggcuggcaggccuaga

SEQ ID NO: 4200246 - RNA, 58 nt, Human
ucaggcuuuuucucaaccucuugcugccagguuugcauugagguagggugggggcuga

SEQ ID NO: 4200247 - RNA, 65 nt, Human
ucagggaagacuucuuagaggagguagcaguuaagcuagcccuuaaagaauaagucuuaucuuga

SEQ ID NO: 4200248 - RNA, 56 nt, Human
ucagggagggaccugaggcuggaggcguuccaagcuggagccugggcucugccugg

SEQ ID NO: 4200249 - RNA, 55 nt, Human
ucagggcaagauugguuaauaauuaaagaaucuauuauuuaucaauuugcccuga

SEQ ID NO: 4200250 - RNA, 59 nt, Human
ucagggcuagggaaguugagugauggguuuuuuccaacugcuucuuuucuggcccauga

SEQ ID NO: 4200251 - RNA, 58 nt, Human
ucagggucaggacccagcuguuccaaccaccccguggcagagguggccugaccucuga

SEQ ID NO: 4200252 - RNA, 55 nt, Human
ucagguccuuuugguguauauuucauaaggguguaggugcauggagggguccuga

SEQ ID NO: 4200253 - RNA, 72 nt, Human
ucaggugauaugcuacgugcuguguaaguaucuuauuaaauauucacagcaacccugaggcgaguuacauga

SEQ ID NO: 4200254 - RNA, 68 nt, Human
ucagguggggcagccagguaccuuuauaguaugauuugaaggccucaggugaggcugcccuagccuga

SEQ ID NO: 4200255 - RNA, 71 nt, Human
ucaggugguagagugucauaacagugcccaucacgcaagugagacuguggcucucaugcacucccaguuga

SEQ ID NO: 4200256 - RNA, 79 nt, Human
ucaggugugcccuguuuggaggcuuguuggccuggggaagcuggaggcaggcuaacuacaagcggggcauccuaccuga

SEQ ID NO: 4200257 - RNA, 82 nt, Human
ucagguuaauuuugaccauagaauggauugacaagauuuuaauauacgaaauuuuucauuuuucucuggagaaauuucuuga

SEQ ID NO: 4200258 - RNA, 66 nt, Human
ucaguaacagagaacucagguguuaggaggcauuauugccagcugccuagaguuuucuguuacuga

SEQ ID NO: 4200259 - RNA, 73 nt, Human
ucaguaagugccaggcucuugcaguguguccugaguuucucauggcacuuagcacaguccucacacuuacugg

SEQ ID NO: 4200260 - RNA, 72 nt, Human
ucaguaauauuuuacucuaggccagagguuggcaaacuucuugguaaagggcuagagggcaaauguugcuga

SEQ ID NO: 4200261 - RNA, 69 nt, Human
ucaguagaaaggggucaggcauguucugcucuguccagcagacacagggcaaugcuuugaccucacuga

SEQ ID NO: 4200262 - RNA, 87 nt, Human
ucuccaugaugaaagguugucuguauugaaguaggagaagucagauuucucucucagccauuacagaaccucauauaugauggaaga

SEQ ID NO: 4200263 - RNA, 69 nt, Human
ucuguaggaggggcuucccaccagcucugaucauagcucagccagcucccaagugagccccuuggcaga

SEQ ID NO: 4200264 - RNA, 74 nt, Human
ucuguaggcuggaaguccaagaucaaggugccagcauguuuggugucuucugagacuucucuuugguuugcaga

SEQ ID NO: 4200265 - RNA, 70 nt, Human
ucuguaggugccugggagcucccugaggaugaagucaucugccuagggccuaaccagagccugccacaga

SEQ ID NO: 4200266 - RNA, 69 nt, Human
ucuguaguggccugaggcaauagucagacauggcugguagagcugugcugccucagaagucauccugga

SEQ ID NO: 4200267 - RNA, 60 nt, Human
ucuguauauauuguggcagagaaauugucccaugauaaucuugguugcaguauauccggg

SEQ ID NO: 4200268 - RNA, 69 nt, Human
ucuguauccaguggaaauuguguucauuuuaaauuaaaauaaaaugaacgguguccaucuguuugugga

SEQ ID NO: 4200269 - RNA, 62 nt, Human
ucuguaucucacuucuuuguggcucccaaccccaccacuccacccagagagcuagguacaga

SEQ ID NO: 4200270 - RNA, 78 nt, Human
ucuguaugauagggaugaagaugguauuucuucagaagguagugaugaggaauaaauaucucauucuuggcauguagg

SEQ ID NO: 4200271 - RNA, 67 nt, Human
ucuguauucaguauuuuccuuguuaacuuaagaaauauuuuuuguugaugauaauacugaugacgga

SEQ ID NO: 4200272 - RNA, 56 nt, Human
ucugucacacuaaaacaagaaguugggucauauucacaauucuaaauugugacaga

SEQ ID NO: 4200273 - RNA, 59 nt, Human
ucugucacuuauuaagauggauggcuggagugcagcuuuccauuacuggaaauggcaga

SEQ ID NO: 4200274 - RNA, 62 nt, Human
ucugucacuucaguuuugaaacaagcuguuuuagcuuggugauuccaaaauaaaguuucaga

SEQ ID NO: 4200275 - RNA, 58 nt, Human
ucugucauguuucauguuuguaggaaaauuugacaaagggccuauacauggagacagg

SEQ ID NO: 4200276 - RNA, 88 nt, Human
ucugucauuucugauagauuucugacacaggaaugccagcaacaauacuaaggguguucuuaaucccacaaaucuucaaggugacaga

SEQ ID NO: 4200277 - RNA, 81 nt, Human
ucuucagugaaucucauagcaaagcuccguaguuauuuuccauuaagugucaaauaucucagcuggcuaugucccuaaaga

SEQ ID NO: 4200278 - RNA, 70 nt, Human
ucuucagugauuguacuguugugccuauguggugugcuuuuuagguacaguagacagacaguuaaaugga

SEQ ID NO: 4200279 - RNA, 61 nt, Human
ucuucagugucacaagagcaagccugcccccaccagcgccacagugaggugacacagaaga

SEQ ID NO: 4200280 - RNA, 62 nt, Human
ucuucauguuaguuggguuuucugugacuugcgucaccuaaaaaagacauaacaaaugaaga

SEQ ID NO: 4200281 - RNA, 63 nt, Human
ucuuccaagaugcuaaaaaauccuuggucugcugacagcaacagggagcugcgucuugaaaga

SEQ ID NO: 4200282 - RNA, 64 nt, Human
ucuuccaggagucugguauuaguccugccaucuggguguuaggggaaagcagaauccuggagga

SEQ ID NO: 4200283 - RNA, 66 nt, Human
ucuuccagguccuucuugagaagacaugaauaacucugcacugucuuuuuccauaacuugagagga

SEQ ID NO: 4200284 - RNA, 81 nt, Human
ucuucccuuggccuucaguuaugugccaaggacaaugagaggguucucagcuguugauggaagugcugaagggagggagga

SEQ ID NO: 4200285 - RNA, 71 nt, Human
ucuucccuuuuucugccauucaaagaggaucugugucccucagaucuuugcaguggugaauaaagagaaga

SEQ ID NO: 4200286 - RNA, 61 nt, Human
ucuuccugcacagaggagccuggcccaaaaaagauaccccaggcuucuccgugcaggaaga

SEQ ID NO: 4200287 - RNA, 69 nt, Human
ucuuccuucuccccauuugccacaagcuuuuucacggguuccauggcagcaguggagguagaaagagga

SEQ ID NO: 4200288 - RNA, 61 nt, Human
ucuuccuuggcucuggucuucauuaucuaggaugguaaaaguacacacagagccaagaaga

SEQ ID NO: 4200289 - RNA, 60 nt, Human
ucuuccuuuucacccuguaacguggguauugcaugauccauguuucugagaaaaguagga

SEQ ID NO: 4200290 - RNA, 73 nt, Human
ucuucgaaaaccuucaaucagcagucuagcuuauauuaauauuuagguuauugaggcuauugaguauugagga

SEQ ID NO: 4200291 - RNA, 68 nt, Human
ucuucgggagaauggaugaguguuugggguguuucaucugcuccaacaauuucccaguuucccaugga

SEQ ID NO: 4200292 - RNA, 78 nt, Human
ucuucuaauuuucauuuugugaaaauguucagugaaacaaauuuuuaaauggcauuuucccagaucgacauuagagga

SEQ ID NO: 4200293 - RNA, 95 nt, Human
ucuucuacaaaauuggaaauauagaauggaaaguguugagagguccauucaaacaucaacauucuuaagauuugugucucacaguuuugagaaga

SEQ ID NO: 4200294 - RNA, 68 nt, Human
ucuucuacccaauggcacugcccaaagagaaaaagacaagcauuuugcuuugugccuuuggguggaga

SEQ ID NO: 4200295 - RNA, 64 nt, Human
ucuucuaucaggaggaaauuuccauuguuaacacuagcaggacaauuuccacuugguaaggaga

SEQ ID NO: 4200296 - RNA, 97 nt, Human
ucuucuaucuuccccaaaguccuggcauggaauugucccugagguaacaguuucugggaccaagaucagcacagaggaaauggggcaggguggggga

SEQ ID NO: 4200297 - RNA, 98 nt, Human
ucuucuccagggcuucagcagacauuauuuucuggcaucaaauaaagggaauuggagccuuaagaauauaguguugcuguugucuacuguggacugga

SEQ ID NO: 4200298 - RNA, 130 nt, Human
ucuucucuguucccuggaaaucuuucugaaguacugcuccuaacccuuggucccugggguuucucccccuccugaggccagugugggaguaguucuuuggaaagcuggcggggaauagcaauagugaaga

SEQ ID NO: 4200299 - RNA, 59 nt, Human
ucuucugccuuggacuagauuacagcaccaguuuuccugguucuccaggcugcagaggg

SEQ ID NO: 4200300 - RNA, 75 nt, Human
ucuucuggggucugccugucuggaugacagaugcaaagggcauaagagucugggacaggcgaggacccaggcaga

SEQ ID NO: 4200301 - RNA, 61 nt, Human
ucuucugugauucuucacuugcuucaggccaccuggauguauacgugcaggucacagggga

SEQ ID NO: 4200302 - RNA, 65 nt, Human
ucuucuucucacccguccauugauuucuccacaccuccagccaacuuccaggguagaggggaaga

SEQ ID NO: 4200303 - RNA, 69 nt, Human
ucuucuucuucaagugcugcauucuuuguaaaugaaagaggccaaucaauagggcaauaaggaaggagg

SEQ ID NO: 4200304 - RNA, 85 nt, Human
ucuucuugcuuguuuauacaucaauugacacacaagagcuguucuuucuucugguccucucugugaugcuauagacuagggaagg

SEQ ID NO: 4200305 - RNA, 66 nt, Human
ucuucuuuacuucauuuccagugaggacauacuuaagucuguuccuuaggaaaaugaugaggggga

SEQ ID NO: 4200306 - RNA, 63 nt, Human
ucuucuuuagcacuugcaccuguguggaauacuacaggaaggcucuggaggugcugaugaaga

SEQ ID NO: 4200307 - RNA, 58 nt, Human
ucuucuuugggcuucauucagaguuggaacuucucaccucucccaggcucagggaaga

SEQ ID NO: 4200308 - RNA, 57 nt, Human
ucuucuuuuugucccacagaauggcugcuauaccauuaggaaggggagggaagagga

SEQ ID NO: 4200309 - RNA, 91 nt, Human
ucuugaaaagugaaucaauagugcuuacauuaucaugaauauggauauauuuuucuuugcucagugaaguacuguucuaaaacuuaagaga

SEQ ID NO: 4200310 - RNA, 97 nt, Human
ucuugaaagaacugugacaaagagcauaugguucucaaagccuuaacuauuuacuaagcuuuacagagaaaguuugccugaucuaguauuuucgagg

SEQ ID NO: 4200311 - RNA, 66 nt, Human
ucuugagaauuuucaguuucacuuuguuuugaacuuugaauccaaagacugcugagaauuuuagga

SEQ ID NO: 4200312 - RNA, 73 nt, Human
ucuugagaguuauuuauauauuuuauaugcaagccccuuguucaaugugugguuuguaaaugauuucucuugg

SEQ ID NO: 4200313 - RNA, 72 nt, Human
ucuugagcagcuggaauuacaggcacgcaccacuacaccuggcugauuuuuguaauuuuaguagagacaggg

SEQ ID NO: 4200314 - RNA, 84 nt, Human
ucuugauccugucugauugauaccaaugugcuuuguggccccuuccuuuuccacgccagagguaucaaagauaguagacauaga

SEQ ID NO: 4200315 - RNA, 67 nt, Human
ucuugaucucuucuagcucugaaauuauggaaaugaaugauucaguuccuagacagagguuucaaga

SEQ ID NO: 4200316 - RNA, 64 nt, Human
ucuugauguauguuguccugccccaagucauggggcugcugggcuggaaaaacaacauacaaga

SEQ ID NO: 4200317 - RNA, 61 nt, Human
ucuugauuuugugaauaaguuguauuggaauuguuucuaguuguugauuauagaaucaagg

SEQ ID NO: 4200318 - RNA, 78 nt, Human
ucuugcaaagcacagaagcuugaaggagcagugaccauccauagaaggacauggcaaaccucaggcuaccuugcagga

SEQ ID NO: 4200319 - RNA, 62 nt, Human
ucuugccaccgucauggccauuauaauugagcaccuaugaugugccauauguuggacguaga

SEQ ID NO: 4200320 - RNA, 123 nt, Human
ucuugccaccucaugggcuacaccuugaccuaacguuuuuauguguauacuugugcuuacucuauaaccuuuuuaggguuugcugcagaugggcauauaggccaggggcaagagguggugaga

SEQ ID NO: 4200321 - RNA, 56 nt, Human
ucuugccagcacauaugcguuggagauggaaauuaaacugcaaaugaugcuggaga

SEQ ID NO: 4200322 - RNA, 64 nt, Human
ucuugccuggcacuccuggagcucacaaaaagccugccacuugugagccugugugccuggaagg

SEQ ID NO: 4200323 - RNA, 70 nt, Human
ucuugccuucaaauucucuuagcugaauauguauucauaguauuaauugaaggguguuuggagaaaaaga

SEQ ID NO: 4200324 - RNA, 65 nt, Human
ucuugccuuugagcuccuugagggcaaggacuauguccucuuuguccuuggcucuagaggugaga

SEQ ID NO: 4200325 - RNA, 57 nt, Human
ucuugccuuugucuucaaaggcucugccaaugugaaguacaggagagagaggcaaga

SEQ ID NO: 4200326 - RNA, 56 nt, Human
ucuugcucuuugaugaauuuuccuuaaauauggggugugggaaaagaagaguagga

SEQ ID NO: 4200327 - RNA, 118 nt, Human
ucuugcugcugcucacucuuuggguccacacugucuuuaugagcuguaagacucaccgugaaggucugcagcuucacuccugaagccagccaagaccacgaacccaccagaaggaaga

SEQ ID NO: 4200328 - RNA, 72 nt, Human
ucuugcuggcugugcuguguuugggccaggcccucuuucgggccugccugaaggucagccacccuguccaga

SEQ ID NO: 4200329 - RNA, 82 nt, Human
ucuugcugggagcccucagucuggcugggaagacagaugcuaaagaugugaucauaccaaucagcugaccucccugcacaga

SEQ ID NO: 4200330 - RNA, 77 nt, Human
ucuugcuucucccuaggugcccuaaggugcccuaaaucaucugggucugcaggagagugcccuagagaagagcagga

SEQ ID NO: 4200331 - RNA, 66 nt, Human
ucuugcuuguugcuaagcagaugauguaagaauauauuaaaaaucauaaauauuagcacaguagga

SEQ ID NO: 4200332 - RNA, 68 nt, Human
ucuugcuuuggaucuauuugcugagcuagaaauuucuggacucagccuuggaaaugaauccugcagga

SEQ ID NO: 4200333 - RNA, 94 nt, Human
ucuuggaagugacaaucaucaccucuguaguauucaaacaaacuaacacugauacaaugugcaagagaacuacacagggaugugacuaccagga

SEQ ID NO: 4200334 - RNA, 98 nt, Human
ucuuggaauucacgagauggaagcauagaucaaagcuguuuggagaaaaucggaaguacaguuuuaucuagccacaucuuggagacauuauugcaaga

SEQ ID NO: 4200335 - RNA, 83 nt, Human
ucuuggagaaaguuguucaguugacuuggagaggaaugcgugggaaugcaguuccaagaaucacugacacagcucuccuggga

SEQ ID NO: 4200336 - RNA, 59 nt, Human
ucuuggagauaaugaccugugacuaguaacuaacuacacaggagaaaagaucucccaga

SEQ ID NO: 4200337 - RNA, 60 nt, Human
ucuuggagugcuagaguauguuggugcuggugagagcacggcuucaucuuuacuucaaga

SEQ ID NO: 4200338 - RNA, 105 nt, Human
ucuuggcucagcccccugaagucagaagggcccuuccuucccauccuuucagaaggaagagagaagaggaaggcaaggucccagugacaggggaagggcccaaga

SEQ ID NO: 4200339 - RNA, 130 nt, Human
uccaauuaaauaugaaucuaagaucaaaccaugaguaguuuguuuaguauaagucugucucaaauguuguacagaacauacuuauacuaaauaauguugguugacuaccugaaauucaaauuugguugga

SEQ ID NO: 4200340 - RNA, 71 nt, Human
uccacaacagagcacauagauuggaguuuguggagccaauuugagcuuuggcuguguugcucugucacuga

SEQ ID NO: 4200341 - RNA, 104 nt, Human
uccacacaggacugcugccugggccugaggaaugcuccugacuuagcuuggggaaggacaggaaguauuccugggacagccugggugggaccaguuagggugga

SEQ ID NO: 4200342 - RNA, 56 nt, Human
uccacagacucaugcuccugaagcaagccacaugugugguggcaugaggguguggg

SEQ ID NO: 4200343 - RNA, 77 nt, Human
uccacagagcuauguuuccagauaugucacccucacagagcaugaugugaauggcacuccuggagguucuggaugga

SEQ ID NO: 4200344 - RNA, 75 nt, Human
uccacagcaacuggaggccuuaucugcuacugguuuuuggcaggcagacaaccaggucuuucaguuuacuuugga

SEQ ID NO: 4200345 - RNA, 114 nt, Human
uccacaggccaugggggcugcauguacgggauuagggauggcaggaggaagguggcccugagcagacagcuauguucccuuuugcuauaacugagguccugggcccacguugga

SEQ ID NO: 4200346 - RNA, 56 nt, Human
uccacaucucuguaggaggaguugcaaaaucacauugcaagcagcagagauauggg

SEQ ID NO: 4200347 - RNA, 89 nt, Human
uccacauucuguugauacuguuagagccagaaaccuacagaguaauuaguuuagguuuugucuacauagcaccaacagaagcaauugga

SEQ ID NO: 4200348 - RNA, 79 nt, Human
uccaccauuguugaaaaucucuugguucagaagccucgguuucuaucaggggcugaaucuccagagauuauuuggugga

SEQ ID NO: 4200349 - RNA, 117 nt, Human
uccaccccggacucuuggucacuguuggcugacagaucuggaucugaacuuuucagauugucuuggguuagaaucagagcagaaucuucaucgccuugugaagggcuccgggaugga

SEQ ID NO: 4200350 - RNA, 73 nt, Human
uccacgcugggccaggcaugugaucagcacaguggacacaguguaagugcacagucugugcccuugugcugga

SEQ ID NO: 4200351 - RNA, 69 nt, Human
uccacguguucuugucguacugggugaacuuggucagguugagccccaggcccuggcagagcuugugga

SEQ ID NO: 4200352 - RNA, 108 nt, Human
uccacuacuaauugaucagagcuggcacuugggacaaaaucuauuugcucuccccgcauuaagguauuguccagaguuucucuuuguuaaaaugucaauacuugugga

SEQ ID NO: 4200353 - RNA, 62 nt, Human
uccacuagauaugguauucacagcaccugguacauuccagauguuuaauacauauuugugga

SEQ ID NO: 4200354 - RNA, 77 nt, Human
uccacuccagcugcccugccucagacuccucaguuucgcacgugaggaucgucuugcaggcacugacuggagaugga

SEQ ID NO: 4200355 - RNA, 62 nt, Human
uccacuccaugccccucagccaguauaagugguggccauauggagugggccauggagugaga

SEQ ID NO: 4200356 - RNA, 69 nt, Human
uccacucugugcuuccauaaauguaaacagugagaaacuguguuuacaugcauaagcuuaagggaugga

SEQ ID NO: 4200357 - RNA, 107 nt, Human
uccacugaagaagaagucgugauuuaugcauuauacuguugagggccguuugggaugccuacaauaaauaacagugcuauaacauccuuguuccuguuucuggugga

SEQ ID NO: 4200358 - RNA, 84 nt, Human
uccacugccaaacugacauuuaauaguauugugggaaccuaccacaggucuugcagaaaauaguauagauuuguuugguaggga

SEQ ID NO: 4200359 - RNA, 129 nt, Human
uccacuggcaugauugcauuguuuaaacaaccaaaugaacucaacagcugacaaauaacccagugguuuccauuguauuuggagcugugugagcucaaaugaucagugaugagaucugccaaaguguga

SEQ ID NO: 4200360 - RNA, 83 nt, Human
uccacuucagggguacuuagcaccuauggcauuuuuuugugacaggagagaagacagagaguguggguacauauccuggugga

SEQ ID NO: 4200361 - RNA, 63 nt, Human
uccacuuccauggaaacaagucacuuuaucuugaagguuucccuuuagcuugccuggaaggga

SEQ ID NO: 4200362 - RNA, 72 nt, Human
uccacuucuugucacugcauccccagcuccugguacaucgugggaguggggcggacaggaccaggaaguggg

SEQ ID NO: 4200363 - RNA, 56 nt, Human
uccagaaaauuuuacagugccuuguugucagugugaagaacuguugauuuucuggg

SEQ ID NO: 4200364 - RNA, 59 nt, Human
uccagaaacuuuuccagucucagggauuccucuggucguagagacuguugaguuguggg

SEQ ID NO: 4200365 - RNA, 97 nt, Human
uccagaacaauauaaagcaguguaacagguugaagagacuuuaaauuagaucaucugguacagagcuucucaaacuuggcacuauugauauuuuggg

SEQ ID NO: 4200366 - RNA, 90 nt, Human
uccagaagccaaagcaagggcugaagacucccuggucucuuucucuccauggcccaaggagaacagucaggucuuugguuagcuucagga

SEQ ID NO: 4200367 - RNA, 63 nt, Human
uccagaagccugccucagaugcacucacccuucuuggcaggcaucagggguagguguuuagga

SEQ ID NO: 4200368 - RNA, 105 nt, Human
uccagaauauguuacaaguauauuuguuaagauuauucagcaucaagguaaauuuuagcugaagggcuuuucacaauaucuuguaugacacaugcuucaauugga

SEQ ID NO: 4200369 - RNA, 58 nt, Human
uccagaaugcuuggaaccugaaguucuucaacagagaacaaauaggcaagcaucagga

SEQ ID NO: 4200370 - RNA, 78 nt, Human
uccagaccacauucucuuacauuuucucagccuugcucugugaguuagguaaagacagugaaagagggucaaaaugga

SEQ ID NO: 4200371 - RNA, 84 nt, Human
uccagaccccucaacuagcccaggaagugugccugagcaccucccaucuuucagggaucuggguucaccaugcuccugggugga

SEQ ID NO: 4200372 - RNA, 73 nt, Human
uccagagaauuaaacgugcuucauauuuuuagcuuaauuuauuagauuuacaagcacuguuuaaaugcuugga

SEQ ID NO: 4200373 - RNA, 109 nt, Human
uccagagagcucagagauuguuuuuggcaaaggacucaaagcaggcagauccaaccccucucgcugucucuuucuuguugccaaaacauaagacucuuaguuuuaugga

SEQ ID NO: 4200374 - RNA, 58 nt, Human
uccagagauaacuauuuaggagguuguuguuuucuuccugauuuuggucuuuuuugga

SEQ ID NO: 4200375 - RNA, 88 nt, Human
uccagagccaccggcugugucccacacgagguguaugugucugugugcucaugcuugugucuggacaugcacugcauguggcugugga

SEQ ID NO: 4200376 - RNA, 58 nt, Human
uccagagccuccuccagcugcaggucugggaucugaagcucagcugccagcucaugga

SEQ ID NO: 4200377 - RNA, 57 nt, Human
uccagagcuacuugcucaacuuauuaauaauuuguagaguguuauaguaguuuuggg

SEQ ID NO: 4200378 - RNA, 94 nt, Human
uccagaggagcuuguguuccaugcugugcaucuugaugacccaagccugaaggucacaaggguggcacagugggggagggcuuaagcaccugga

SEQ ID NO: 4200379 - RNA, 68 nt, Human
uccagagggccuccagggcagcaguggcuugucccgagcugauggcauaugacuggggguucccugga

SEQ ID NO: 4200380 - RNA, 85 nt, Human
uccagauaauguuaaagaggacagagugcuggauuuagugucaggaaugcugaaaucuuuaguuucugucccuuuuaccuaugga

SEQ ID NO: 4200381 - RNA, 102 nt, Human
uccagauacucuuuugaaggauuauguaacuaaguaauagcuuaaaagguaauaguuaauaucuuggcauguauuaguuggcaguuguugaaaaggagagga

SEQ ID NO: 4200382 - RNA, 56 nt, Human
uccagauccucaguguuucgcuuuuccccauggaauggcaccaggcuaggauugga

SEQ ID NO: 4200383 - RNA, 87 nt, Human
uccagauguaaagauggucccaaaaggacaugggaaguucuauuagggaacuauuuccaauuguucuuuggaaucucucucuuugga

SEQ ID NO: 4200384 - RNA, 60 nt, Human
uccagcacuggccugaguaucugugucaaucccagcauggguguccagggcgugucugga

SEQ ID NO: 4200385 - RNA, 75 nt, Human
uccagcagcucagggagagggcaccaagcaccugagggcuggaggcgagccucucacugggcgacuucagcuggg

SEQ ID NO: 4200386 - RNA, 56 nt, Human
uccagcagugcucaggacucacuaaugcagggagugacauucuaacacugacugga

SEQ ID NO: 4200387 - RNA, 57 nt, Human
uccagcccgacugggccugccggggcugccccgcgcacgguaaggcccggggcuggg

SEQ ID NO: 4200388 - RNA, 56 nt, Human
uccagccggcucugacagcuggggccaaggcucuucccagagaagagcuggaugga

SEQ ID NO: 4200389 - RNA, 56 nt, Human
uccagccguauguuauuggacauucagaugccuggggugcaugguguaugacugga

SEQ ID NO: 4200390 - RNA, 59 nt, Human
uccagccuaggggaacagcugcccccaguccacugugucccggcuuccccuagucuaga

SEQ ID NO: 4200391 - RNA, 59 nt, Human
uccagcuccagagaguccagcucuggggucaucuauccugggcagccucucuggaagga

SEQ ID NO: 4200392 - RNA, 71 nt, Human
uccagcugggauguugcacauggaacagauugaucuugaaaucugguccugaagucaacuucacagcagga

SEQ ID NO: 4200393 - RNA, 67 nt, Human
uccagcugguugaagaggagcuggacugugcucaggagcgccuggccacugcccugcaaaagcugga

SEQ ID NO: 4200394 - RNA, 77 nt, Human
uccagcuuuauuuccaaaggcuaaacucaguuugacagacagagcccuucacagacuguugucauuggagagcugga

SEQ ID NO: 4200395 - RNA, 62 nt, Human
uccaggaauagucauguuuuaggccuaagaucuauuuuuacaacuagaaagacuuucuugga

SEQ ID NO: 4200396 - RNA, 68 nt, Human
uccaggagauacacugcaccagccaagaagcacgaaacacaggaauggaaguggagugucuuccugga

SEQ ID NO: 4200397 - RNA, 58 nt, Human
uccaggagaucucgccauugucuggguugcagccaggggcccagacagauauccuggg

SEQ ID NO: 4200398 - RNA, 64 nt, Human
uccaggaggcagagaaaacuuccgucuguggcucucuagcagcaguggaaugucucuguuugga

SEQ ID NO: 4200399 - RNA, 57 nt, Human
uccaggagguagcgaguggacagugcagguuucugcagucccucucccugcucagga

SEQ ID NO: 4200400 - RNA, 61 nt, Human
uccaggaugagcaugauugaaaucacuaauuuauuucuauagcuucagucucuguccugga

SEQ ID NO: 4200401 - RNA, 61 nt, Human
uccaggcaaagccuuguagacguauucucguuauugagucuuuuucuuuaggguuucugga

SEQ ID NO: 4200402 - RNA, 63 nt, Human
uccaggcaccagugagaagggccuuucaccagacuugagaggucagcaagggugcucuaagga

SEQ ID NO: 4200403 - RNA, 92 nt, Human
uccaggccgcagucuggcuaaacuggauuaccaggcuggugggcagcuccucaccaugauccugcaccaguuagagccugcuguaguuggga

SEQ ID NO: 4200404 - RNA, 79 nt, Human
uccaggcucucgaucaccguggccacuuugagggagcggucgugcacacucagcuuggccuggacguagcgggccuggg

SEQ ID NO: 4200405 - RNA, 59 nt, Human
ugaaaagacugcaagagagcauuucagcacaauaggauugccucuuguucucucuuuca

SEQ ID NO: 4200406 - RNA, 79 nt, Human
ugaaaagcuccaguaggcugugugaggcuagagagcugaaccaaaagaucugccgacuauaagccaacuaguuuugcca

SEQ ID NO: 4200407 - RNA, 68 nt, Human
ugaaaaggagccuuagguagguuauauguauagcagauaucuuccccuacucuauggcuuccuuuuca

SEQ ID NO: 4200408 - RNA, 107 nt, Human
ugaaaaguggggaagcaaaucaauuguguagaugacucaagccaaagaaacugcccuugaguaucaauuacauaguuguuuugugcauucucuauggguacuuuuca

SEQ ID NO: 4200409 - RNA, 112 nt, Human
ugaaaaugcccuguaaacgaaacccacacagucccgugcuuaccauguuguugcaccuccuucauauggacuuuguaugugguuguauguauuuuuauagggcagauuuuua

SEQ ID NO: 4200410 - RNA, 71 nt, Human
ugaaaaugcucacuaaauaacaggaagaaugaacaacuauuuauaucuagauggauuuuagugaauuuuca

SEQ ID NO: 4200411 - RNA, 78 nt, Human
ugaaaauguaacucuuagauucauucuguuuuagagcuagaagcaucugaaagcaaauacaugaaucuugcguuuuua

SEQ ID NO: 4200412 - RNA, 111 nt, Human
uccuaaaaucccauagauaauaccaacuugcagccaaauuugagaaucagugcacuacccuaaauuuuucaguucaaaugaauuugguauuggucaaugagaggucaagga

SEQ ID NO: 4200413 - RNA, 81 nt, Human
uccuaacacugagaacuguuggugguccuucucccaugauggugaaagcagauacacuaaucaugugcucagugaaaggua

SEQ ID NO: 4200414 - RNA, 67 nt, Human
uccuaaggcuagugccugacuggguuacauuacuaaaugaaguuggugaguaggcuggcuugaagga

SEQ ID NO: 4200415 - RNA, 90 nt, Human
uccuaauccccauaacuuuugaauauguaugcuuaugugguaaaaacgacauugcagauguguuuaauguuaacaaucuugagauaagga

SEQ ID NO: 4200416 - RNA, 69 nt, Human
uccuacaaauuuggaaccucacacagaagcagcugcuauugcagaugcuuuugauucugggguguagga

SEQ ID NO: 4200417 - RNA, 70 nt, Human
uccuacacacaugaauuuauaaacugagagucauaccugcugcaguugcuacaguucaagugugaaagga

SEQ ID NO: 4200418 - RNA, 86 nt, Human
uccuacagaguucacaggauuuuaugagggcucaaugagucuacauacguaaaaugcuguuauauuauuuccgagucauguaagga

SEQ ID NO: 4200419 - RNA, 60 nt, Human
uccuacauagccagaagcaaguucauuaugacuuagaauauuguacaugguuaugcagga

SEQ ID NO: 4200420 - RNA, 72 nt, Human
uccuacgugggaaaaagcaggcuacugaggacaaaaaccucccaacccuccccaccuuguuuuccacuggga

SEQ ID NO: 4200421 - RNA, 69 nt, Human
uccuagaccuaguaucagacucugcugcuccucacuggcauaaaggcagacccugaacugggcaugggg

SEQ ID NO: 4200422 - RNA, 68 nt, Human
uccuagacugggcccaccuggcaguggccaugcuggggcuaucaccaggggcuggugcugagcugggg

SEQ ID NO: 4200423 - RNA, 58 nt, Human
ugacuguuaucugcacguagaguuuucugcuucagaaaauuaggcuagaugacauuca

SEQ ID NO: 4200424 - RNA, 116 nt, Human
ugacuguuuaccuucccucuuccauggaggcagcaagauuuuuaaagcaaggugagaaaucgcuuugucuuugaucauuuugacuuuguggaauuaaaugaccaggaugaaaguca

SEQ ID NO: 4200425 - RNA, 129 nt, Human
ugacuucauugaaaacgagcauucaguuuggcucucuuguaagguaguagaauacaauucaauaaagcucuguuuuguaccuuuuuggggggcaugcugguaguuccaugcuuguuuucucauuuggca

SEQ ID NO: 4200426 - RNA, 85 nt, Human
ugacuucuuugcagcuuagugauguuaucugaauuauuuuuauuguaugcagcauuaagcaauuugcuccuaagaaaacgaguca

SEQ ID NO: 4200427 - RNA, 59 nt, Human
ugacuugccugcacugagccuauucugcugauaagauaggcuuuugugcagagcaggca

SEQ ID NO: 4200428 - RNA, 78 nt, Human
ugacuugcguuuagcucuuuguagcuauuucuagucacugauucuauggaaagucgcuaaggaguuagucgcuuguua

SEQ ID NO: 4200429 - RNA, 56 nt, Human
ugacuuucagcuguauuuaucuaggauuaaucuuggaagaguagaguugaauaaca

SEQ ID NO: 4200430 - RNA, 77 nt, Human
ugacuuuucauccccuucacacccucugcauuucccuuuuggagagcucagagggaggugaagugggaagaaaauca

SEQ ID NO: 4200431 - RNA, 129 nt, Human
ugacuuuuggucauguuuuaguugguauuugcuucugugggugccuauggcugaagguaaauguuuguuuucuuaaccugggcaucaacaagcagagaugacauaaaaaugaguuuagauugaaaguua

SEQ ID NO: 4200432 - RNA, 62 nt, Human
ugagaaaagguugagaugauaauuuccuuuucauuuuauuugucuucauuaaucucuucuca

SEQ ID NO: 4200433 - RNA, 55 nt, Human
ugagaaagaugucuaggaaauaugcccauaguuucuuucuugaacauguuucuca

SEQ ID NO: 4200434 - RNA, 83 nt, Human
ugagaagagcuacuugugaauggacaauuaaaucuagauguauuuagaucugauacaauucaucuguagccaaccuuuuuuua

SEQ ID NO: 4200435 - RNA, 70 nt, Human
ugagaagagcuggauggaaucugggaugaguaacaugaguauccguaggaagaccaccaguggcuacuca

SEQ ID NO: 4200436 - RNA, 91 nt, Human
ugagaagauggaaauucauuuacauaacaguaacgcugaaucaauauauuuucagcuugcccugauguggaagaaauauaccaucucauua

SEQ ID NO: 4200437 - RNA, 62 nt, Human
ugagaagauggucaucugaaagccaggaaaagagacugcuccagaaccugaccaugcuggca

SEQ ID NO: 4200438 - RNA, 84 nt, Human
ugagaagcaauauccuaaaugaagcuggauguaggaucccccuguuguauaauggaguuuuguauccagcuucagcuuaucuca

SEQ ID NO: 4200439 - RNA, 77 nt, Human
ugagaagcacugugcaucuagucucaggcuucagagagaauucccuuucuagucuauggcuagauaguugucacuca

SEQ ID NO: 4200440 - RNA, 99 nt, Human
ugagaagcagaagucuaugaaauuuuaggaggucgauuguucacaccuauuugcaagacuucauuguaauauuauagcaccuucuuccaucugcucuua

SEQ ID NO: 4200441 - RNA, 55 nt, Human
ugagaaggccagaaaauuccuuuaggggccugaaggcuuggauuggucauuuuca

SEQ ID NO: 4200442 - RNA, 66 nt, Human
ugagaaggugaaaguguggagaaaagauguccuucccucagccaugacacaucuaucacauuuuca

SEQ ID NO: 4200443 - RNA, 62 nt, Human
ugagaauauaauuuuauuccuagaguuuuaaugugugggcucuaaaauggaguuuuaucuca

SEQ ID NO: 4200444 - RNA, 90 nt, Human
ugagaaucgcuugaacccaggagacagguugcagugagcugagaucgcgucacugcacuucagccugggugacagugcgagacugucuca

SEQ ID NO: 4200445 - RNA, 98 nt, Human
ugagaauucuggggcaagaaaguguuuacauugcuauaagagguauuaagaacggcuuccuguauuagguagacaacuauuuuuccauuaguuuucca

SEQ ID NO: 4200446 - RNA, 99 nt, Human
ugagacaaagucucgcuuuguagcccaggcggagcuugcagugagccgagaucacgccacugcacuccagccugggcggcagagcaaaacucugucuca

SEQ ID NO: 4200447 - RNA, 97 nt, Human
ugagacagagucucugucgcccagguuggaguucaguggcgcgaucucggcucacugcaagcuccgccucucggguucacgccauucuccugccuca

SEQ ID NO: 4200448 - RNA, 102 nt, Human
ugagacagaguuucgcucuugaccccgaggcuggagugcaguggccugaucuuggcucacugcaaccucugccucccggauucaagcgauucuccugccuca

SEQ ID NO: 4200449 - RNA, 107 nt, Human
ugagacagaguuuugcucuuguuguccaagcuggagugcagugcaauggcgcaaucuuggcucacugcaaccuccgccuccuggguucaagugauucuccugccuca

SEQ ID NO: 4200450 - RNA, 99 nt, Human
ugagacaggagaauugcuugaaccagggaggcggagguugcagugagccgagaucgugccauugcacuccagccuggggaacagagcaagacugucuca

SEQ ID NO: 4200451 - RNA, 59 nt, Human
ugagaccaucuguuuaaagcagugugcacagaacuuggcacacaaacagauggugcuca

SEQ ID NO: 4200452 - RNA, 57 nt, Human
ugagacgaagucuugcucuguugccaagcuggagugcaguggcacgauuucggcuca

SEQ ID NO: 4200453 - RNA, 101 nt, Human
ugagacggagucucgcucugucacccaggcuggagugcaguggcgggaucucggcucacugcaagcuccgccucccggguucacgccauucuccugccuca

SEQ ID NO: 4200454 - RNA, 101 nt, Human
ugagacggagucuugcucugucacccaggcuggagugcaguggcuugaucucggcucacugcaaccuucgccucccggguucaagugauucuccugccuca

SEQ ID NO: 4200455 - RNA, 101 nt, Human
ugagacggugccuugcucuguuucccaggcuggaaugcaguggugugaucuuggcucacugcagccuccaucucugggguucaagcgauucuuccgccuca

SEQ ID NO: 4200456 - RNA, 57 nt, Human
ugagacugauugauagauggaagacauaaaacgaaacuucuaucucuucaaguuuca

SEQ ID NO: 4200457 - RNA, 129 nt, Human
ugagacuggggggcauuuuaugguuauaagagcuaaaugauauuuaugcaaguguguaaacauuaauaacucagcguuuauaagcauguuagaauauuugauuauggcuagggaaaugcauauuagcua

SEQ ID NO: 4200458 - RNA, 75 nt, Human
ugagacuuugggugauccaguccauggcagaacccaaaugagaacugccuggcugagaccuucccaaauucuaca

SEQ ID NO: 4200459 - RNA, 77 nt, Human
ugagagaaaauagcacagcagcugaggcuugguuugaggacuucuagcuuuuauauuguauguguuuaauuuuuuca

SEQ ID NO: 4200460 - RNA, 69 nt, Human
ugagagaaacguuccuuacauccuccuccuccacagcaaaaugguuucaggguguggggacaucuguua

SEQ ID NO: 4200461 - RNA, 71 nt, Human
ugagagacagcagggccagggccugccagcaaagucuucaaugcucacagccccaucaccuguugcucuca

SEQ ID NO: 4200462 - RNA, 57 nt, Human
ugagagaccugugaguguauuucagaaggccaugaaauguugccaugaggucuccca

SEQ ID NO: 4200463 - RNA, 123 nt, Human
ugagagauugaagggaaggaugaaaggagugaaauuuucacugacgggugaaaaguaaccaauauuggguauagcucagcaccccgacaggacauucuuugucauaugcuaaucaauuuuuug

SEQ ID NO: 4200464 - RNA, 80 nt, Human
ugagagcaaccaccuaacaguggggaaaagaguugguggagaagcaccaccaucuugcccuccuugagugggaacuuuua

SEQ ID NO: 4200465 - RNA, 65 nt, Human
ugagagccuguguucaaaugccagcucuguccuuucccgcugagucaccuugaacaggcuacuca

SEQ ID NO: 4200466 - RNA, 74 nt, Human
ugagaggggauggguauguuuguggccuugauggugguaaugauuucacagguacauccuuauccccaaacuca

SEQ ID NO: 4200467 - RNA, 117 nt, Human
ugagagggugcuggaaggaugugcauugcaggugcccagcuggcuuccagcacaucccaaggggaugaaugugggggccacugugcaccugccuuuuggaccagacuuucucucuca

SEQ ID NO: 4200468 - RNA, 62 nt, Human
ugagaguggcaucccuuuaacaggguagagucccucuggcuuugaauggcugccacuuauca

SEQ ID NO: 4200469 - RNA, 55 nt, Human
ugagaguucucucuucaggugggaaguauaaagccuucuccaccugcagcucuca

SEQ ID NO: 4200470 - RNA, 61 nt, Human
ugagauaagcaaggauaaagguuuggaggcaaggcagacaccacaauuccugcuuaucuca

SEQ ID NO: 4200471 - RNA, 72 nt, Human
ugagauaagugauacauaaaaagacaaaacacuuuaaaugggugaauuguacaguaugugaauuauaucuca

SEQ ID NO: 4200472 - RNA, 126 nt, Human
ugagaucagacuccugcccaaagagagauguccaagaggucugagcaaucucaagccuguaucuaaggcuaaacugugaucuucaguccaucaaagucucuuuuucugcuagucuuucccaucuca

SEQ ID NO: 4200473 - RNA, 55 nt, Human
ugagaucauugacuuguuccugggggccucucucaaggacgagguuuugauuaca

SEQ ID NO: 4200474 - RNA, 64 nt, Human
ugagaugaacuugauuguuuuaggacuaaauguuuuuauucaauugacaauuagagaucacuca

SEQ ID NO: 4200475 - RNA, 74 nt, Human
ugagaugaagugauguaaaacauggggcuacuguuuucucuccaucuccccucgccuugccucgccucaccuca

SEQ ID NO: 4200476 - RNA, 111 nt, Human
ugagaugaauacaugcuuuauaaugguaauuucacauauaggggaagcuacaacagcaguauaucauggcagcuucuuaauauggagaccaaggccuaacuauucaucuua

SEQ ID NO: 4200477 - RNA, 57 nt, Human
ugagauggaaggugaggcaguagacucugaagucagaaagccuaccuuuguaucuca

SEQ ID NO: 4200478 - RNA, 58 nt, Human
ugagauggagucucacucuguugcccaggcuggagugcagcggagugaucucugcuua

SEQ ID NO: 4200479 - RNA, 58 nt, Human
ugagauggagucucgcucuguugcccaggcuggcgugaaauggcgugauuucggcuca

SEQ ID NO: 4200480 - RNA, 57 nt, Human
ugagauggagucucgcucuguugcccaggcuggggugcaguggcgagauccggcuca

SEQ ID NO: 4200481 - RNA, 57 nt, Human
ugagauggagucucgcucuguugcgaggcuggaauagaguggugcgauuucggcuca

SEQ ID NO: 4200482 - RNA, 100 nt, Human
ugagauggagucuucuucuguuacccaggcuggagugcaguggugugaucucagcucacugcaagcuccgccucuggguucaagagauucuccugccuca

SEQ ID NO: 4200483 - RNA, 90 nt, Human
ugacuugcagcagccuaugguacucucuugucugcaaauuuucugcccugauuaauuacaaagagugccagaguguguugacguuaguua

SEQ ID NO: 4200484 - RNA, 67 nt, Human
ugacuugccuaaagaacaaauggucuugaagaaaauucacguguuuauugcaucuuaguguaaguca

SEQ ID NO: 4200485 - RNA, 81 nt, Human
ugacuuggcuggcuuucuuguauuuacuuugauggaccuaggguuagggcuuuuguagguacuagagaccagaugugguca

SEQ ID NO: 4200486 - RNA, 60 nt, Human
ugacuuucaagguaugccugggcuugcccuccuggguucugccauugccaugagggcuca

SEQ ID NO: 4200487 - RNA, 90 nt, Human
ugacuuucgccuuguugcaacugauggagcaugugugcuuccucugaggccagccuacaggaggcagcuguuucgcagguggugaauucg

SEQ ID NO: 4200488 - RNA, 57 nt, Human
ugacuuucuaagcuuaguaugaggcaguaaauguacugcagcuaguuggggaaagca

SEQ ID NO: 4200489 - RNA, 88 nt, Human
ugacuuugaaucggcuggaccuagacuagcucauagaucuagaacaaguauuggcagucuaguguccuugggccccuuugaucaguca

SEQ ID NO: 4200490 - RNA, 73 nt, Human
ugagaaagaaggacucugcauuuuccuggcucucuccucuacuugcuuaggcauccaggguucuuccgccuug

SEQ ID NO: 4200491 - RNA, 58 nt, Human
ugagaaagguauuucaugcacuuaagagagagacagagaguaugaaaguccacucuca

SEQ ID NO: 4200492 - RNA, 68 nt, Human
ugagaaauuaccauuguaaaguauuucuacacuuauuauuaagaaagucucauugugguaguuucaca

SEQ ID NO: 4200493 - RNA, 68 nt, Human
ugagaagagaagaaagugucuacacagaaguuaguuuuuguuuaauuugauauuuucucuuuaccucg

SEQ ID NO: 4200494 - RNA, 66 nt, Human
ugagaaggaugggcaagauuuccccaugugagaauccuuuaugugcauuaucuaguucauuucuua

SEQ ID NO: 4200495 - RNA, 60 nt, Human
ugagaaucauccagaggcuucuuaaaauaugcacuaugaggccucauccucagauuuuca

SEQ ID NO: 4200496 - RNA, 84 nt, Human
ugagaauuacugacuguggggggcggacacaaggggucagcugaggagcgcaguuugugacuuucccuauaggcagugaccucg

SEQ ID NO: 4200497 - RNA, 70 nt, Human
ugagaauucuggaguugggaggaaaauagaaaccauaauauauuaauuccuaccaaacuuugaguucuca

SEQ ID NO: 4200498 - RNA, 65 nt, Human
ugagaauucugggucuaggguuguaucuguaaagggaggcagcccacaggacacaggaaguauca

SEQ ID NO: 4200499 - RNA, 101 nt, Human
ugagacacagucuugcucugucacccaggcuggagugcaguggugccaucucagcucacugcaaccuccagcucucagguucgagcgauucucaugccuca

SEQ ID NO: 4200500 - RNA, 102 nt, Human
ugagacagaguuuugcucuuguuccccaggcuggagugcagugguacgaucucggcucacugcagcuuccgccuccuggguucaagcaauucuccugccuca

SEQ ID NO: 4200501 - RNA, 65 nt, Human
ugagacagauggagcuacuagguaaagcaucauuauugcuguuucagucucuauuugaaacauca

SEQ ID NO: 4200502 - RNA, 62 nt, Human
ugagacagcccuucugcacaggggaggauaaaacucaagaugcuuucuuggagggcuucuca

SEQ ID NO: 4200503 - RNA, 59 nt, Human
ugagacagcuguggagaggcauguguuagugcuccagccaacagucccagcugagcuua

SEQ ID NO: 4200504 - RNA, 101 nt, Human
ugagacaggagaauugcuugaacccuggaggcggagguugcagugagcugagcacaugccacugcacuccagccuaggugacacagcaagacuccaucuca

SEQ ID NO: 4200505 - RNA, 64 nt, Human
ugagacauauuauacugcuuuuaucuuuacuuuugaaaggcaaugcagucauggaaugcucuca

SEQ ID NO: 4200506 - RNA, 106 nt, Human
ugagacggaguuucgcucuuaucguccaggcuggagugaguguaguggcuugaucucagcucacugcaaccuuugccucccgggcucaagcgauucuccugccuca

SEQ ID NO: 4200507 - RNA, 64 nt, Human
ugagacgugggucuucccuuggcuguguuuaauucacucuucuauggaauaccaaugauucuca

SEQ ID NO: 4200508 - RNA, 88 nt, Human
ugagacugggaaggagggcaggaacuggcaggcagggcaggggccuggccuggccugcucggcucuuaaguccuggcuucaccacuca

SEQ ID NO: 4200509 - RNA, 129 nt, Human
ugagagaagaaggcucugauuuccuaaccucuagcugcauauuuuauccauuagaccucugcuuucuggugaaaacugcauaugcacugauaguuugggaacacugcaauuagaucacuuugccuuuua

SEQ ID NO: 4200510 - RNA, 70 nt, Human
ugagagaagggauucuaaugaaaugagccccaaguucaauuugaauuucuuauugggagaccuuuucuca

SEQ ID NO: 4200511 - RNA, 57 nt, Human
ugagagaaugacucgacagaggucugcaucaggcaaucucaggcgagaauucuuuua

SEQ ID NO: 4200512 - RNA, 63 nt, Human
ugagagacugaacuagcacauuuuuauaaaacuggaucaaaaugugcuugugaucagcuguca

SEQ ID NO: 4200513 - RNA, 79 nt, Human
ugagagacuucacuagcaugguacaauguuaacauaaaaagaagaaugucagcugugauccaucuaucuagucuucuca

SEQ ID NO: 4200514 - RNA, 79 nt, Human
ugagagaguuuguugcccuuaggauuccagauaaaugacagcguuguauuuauauuagaaugguugcuuaacuuucuca

SEQ ID NO: 4200515 - RNA, 60 nt, Human
ugagagccagaagggccugagguugaagcagccgugccucuucaucuugugagcuacuca

SEQ ID NO: 4200516 - RNA, 68 nt, Human
ugagagcugggcaaaaugugagguugcugcacagcaaugcagugaagccucaccugcucaguaucuua

SEQ ID NO: 4200517 - RNA, 73 nt, Human
ugagaggaaaugucacuuguccaauguuaugcuauucccuaaauagcagagcaugcuaagugacuccaucuua

SEQ ID NO: 4200518 - RNA, 86 nt, Human
ugagaggguggacagggguggucuggggcugagggugguguucucuugggagcugugcacuuccagauggccccaucuaaucucca

SEQ ID NO: 4200519 - RNA, 60 nt, Human
ugagaggucaaagggcauggagcugaaagaaacaucuggauuccaucuuuugaacuuuua

SEQ ID NO: 4200520 - RNA, 107 nt, Human
ugagagucucagccuuuuucuuccugccaaguuacuuuuuuauuagguagauaaacuccugaauuguugagaagcagcuguuugaagaaggauuuggcugauucuca

SEQ ID NO: 4200521 - RNA, 81 nt, Human
ugagagucugcugccucgacauugggacaaauaagacucuugccugucaacaagauguuccgauguuggaggagggcucca

SEQ ID NO: 4200522 - RNA, 63 nt, Human
ugagagugcaaauuauuuaccugauuuagauugauuaaagucaggcaugcugucugcauuuca

SEQ ID NO: 4200523 - RNA, 64 nt, Human
ugagaguuccaaugguaaaauugugggcguuauuuauuuuccauauauuucuuaagaacuuuca

SEQ ID NO: 4200524 - RNA, 79 nt, Human
ugagauaggcacaauuauuaucucuuucuacagaagaggcaaugaagacaaagagaugguaagugaauuaugcauucca

SEQ ID NO: 4200525 - RNA, 100 nt, Human
ugagauauagucuugccugucacccaggcugguaugcaguggcacgaucucggcucacugcaaccuccgccucccggguucagacaauucuccugccuca

SEQ ID NO: 4200526 - RNA, 83 nt, Human
ugagauccacagguccaguguguuuaucuuggauuauaaaucuacuuuuuggcuggacacaguggcucaugccuggaaucuca

SEQ ID NO: 4200527 - RNA, 58 nt, Human
ugagaugaaagcagaaagacuucaguguacauuuauugagucugacauuuuucucuca

SEQ ID NO: 4200528 - RNA, 66 nt, Human
ugagaugaacagucagcuucucgggacauuugcauuagcagaggucuuugccagcgaccacucuca

SEQ ID NO: 4200529 - RNA, 73 nt, Human
ugagaugccauuuuauacucauucaauuuacaaaaaucaaaaaguuggagaggaugugaauggcagagucuca

SEQ ID NO: 4200530 - RNA, 58 nt, Human
ugagauggagucucacucuguugcccaggcuagagggcagcagagcagucuccgcuca

SEQ ID NO: 4200531 - RNA, 57 nt, Human
ugagauggagucucgcucuguugccaugcuggagugcaguggcgcgaucuccauuca

SEQ ID NO: 4200532 - RNA, 58 nt, Human
ugagauggagucucgcucuguugcccacgcuggaguacaguggcgcgaucuccgcuca

SEQ ID NO: 4200533 - RNA, 58 nt, Human
ugagauggagucucgcucuguugcccaggcuggagcacaguggagcgaucucgucuca

SEQ ID NO: 4200534 - RNA, 101 nt, Human
ugagaugggaggaucguuugagcccaggaggucgaagcugcagugagccauggucacgcuacugcacuccagccugggcaacagagugagacccugucuca

SEQ ID NO: 4200535 - RNA, 69 nt, Human
ugagauggugcuguucaaaacuaaaugauucaaaauucuuuuuguguaacuuaugaauagcuucaucca

SEQ ID NO: 4200536 - RNA, 105 nt, Human
ugagauguuacagucacccagauuacauccugucaaaagguccucacaaacuaguaaugaaagacaaccugucaggaguagucauggaguuguuacacacuuuua

SEQ ID NO: 4200537 - RNA, 80 nt, Human
ugagauucuaauagcugccuauguauuuguguucacaaucagguguacaccaaacggagggcaaaugcuguuaccacuca

SEQ ID NO: 4200538 - RNA, 65 nt, Human
ugagauuguuugcauuuugggaaaugccagucaucucucccaaaucugcagauagcagcaucuca

SEQ ID NO: 4200539 - RNA, 89 nt, Human
ugagauuuuuaugcaucucugaaaugcaguuaucuuuucuuacaacaaaugaaagcugaagauaggcauuucagcaugccaagaccuca

SEQ ID NO: 4200540 - RNA, 62 nt, Human
ugagcaagagugaauucauguggcuucagggaacagaacugaggcugauugauuuuugcuca

SEQ ID NO: 4200541 - RNA, 60 nt, Human
ugagcaaggagcagucuuucuuucuaaaauacuagucugguucugcuacucucuugcuua

SEQ ID NO: 4200542 - RNA, 86 nt, Human
ugagcaaugacaccaagaaguugacagccaggugaauguuauacacaagcucaucggcugucaucuucacgugaccaacagcuaca

SEQ ID NO: 4200543 - RNA, 80 nt, Human
ugagcacauuuccaggacuagcauuucugauagacuugacuugggauaagaauguuuauugcagugcugggcuguguuua

SEQ ID NO: 4200544 - RNA, 63 nt, Human
ugagcagaauuuaugacaacgauagccauccgggcuguugacagacauagguuuucuuguuua

SEQ ID NO: 4200545 - RNA, 58 nt, Human
ugagcagaggccagcaccugggagauagagcaguccaguggugaaaagcuucagcuca

SEQ ID NO: 4200546 - RNA, 70 nt, Human
ugagcagcugguuagcaaucuaagugagauuccuaugucugacuaagucagauugcuaaccagcugcuca

SEQ ID NO: 4200547 - RNA, 118 nt, Human
ugagcagcuguuacauuccaaguacacugugcuaguccauuuuacauguguucucuaacaaaaaccuaacaguagauuuuagauuacauaguuggagagguauauuaguccaugcuca

SEQ ID NO: 4200548 - RNA, 56 nt, Human
ugagcaguggcuccugcuggaccuucuuugcaucauccagcuccugccacuccuua

SEQ ID NO: 4200549 - RNA, 103 nt, Human
uccuagagggcauagcagguauagaagggagugauccaggaggacacuggucacaagaauguccuccuggaucacucccuucuauaccuaccauacccuagga

SEQ ID NO: 4200550 - RNA, 93 nt, Human
uccuagaucagcagauuccagucccacccccuugucccagauggagaaacugaggcccauuugcagaagggagggggaccuguugauuaggga

SEQ ID NO: 4200551 - RNA, 72 nt, Human
uccuagcccagggucaccaguucauaggcacagagauuggauccuaggucugucugaccccagaggcuggga

SEQ ID NO: 4200552 - RNA, 55 nt, Human
uccuagcucaagguuuuccauauauuuaauagucaguauaugcuugagcuaagga

SEQ ID NO: 4200553 - RNA, 96 nt, Human
uccuaggcagaugucccucuaguuguuuaauauugauugacuacccacagugggacucuuagauuaagcacacaaaaugggcucugcccuuuagga

SEQ ID NO: 4200554 - RNA, 78 nt, Human
uccuagugccccaagagggcuguggucucauuuagccuuggagggcuguggucucaucuagccuuggggugugaugga

SEQ ID NO: 4200555 - RNA, 70 nt, Human
uccuagugccugccccaaaaugaaagggauuuuucucagcuccuuucagaaggaugugcagguggcaggg

SEQ ID NO: 4200556 - RNA, 64 nt, Human
uccuaguguggggucaccggcccaggggguugcuauccuagguuuuuccugaccucaaccaggg

SEQ ID NO: 4200557 - RNA, 70 nt, Human
ugauaggaugggcagacaggacggcaccagccaugguugcuggcucucccuggcaugccucauuucuuua

SEQ ID NO: 4200558 - RNA, 57 nt, Human
ugauaguaucugauuauuucacaguuaguuuugggaauaauauuacagauacaguca

SEQ ID NO: 4200559 - RNA, 129 nt, Human
ugauaguauuucauuaaguuuuuugccaggaguaagugaguuaaugugucugacacaaugggucuggcacacaaggccuaugcauauauugauuacuguuucagccucagaacuuuaagaaguauuaca

SEQ ID NO: 4200560 - RNA, 93 nt, Human
ugauaguccuacauuaugggguuguugucaggauucagugaguuaacaaagauauggaugcugagaacacugccugauacauuggacacauca

SEQ ID NO: 4200561 - RNA, 62 nt, Human
ugauagugagucauagcugaguuuucgucaguuuacccaauugaccagcugucucauuuuca

SEQ ID NO: 4200562 - RNA, 56 nt, Human
ugcacaagcuuugugauaguagagaucuccuucuauucuggguucaaagcuuugua

SEQ ID NO: 4200563 - RNA, 63 nt, Human
ugcacacagaugguacaugcauauccagaugcacacgcgcacugacguguccaccugugugca

SEQ ID NO: 4200564 - RNA, 129 nt, Human
ugcacacaugacuuauaauacauauauacguauugcaugcauauaugcuacaugcaacauaugcuauaaacauuuugcaugugugcauauauuugcaucacauauguguacauguauacaugugcugca

SEQ ID NO: 4200565 - RNA, 68 nt, Human
ugcacagauacagaagaccccuccgucaugcagcaucugccaugagcaucggccuccugugcugugca

SEQ ID NO: 4200566 - RNA, 68 nt, Human
ugcacagcacaggaggccgaugcucauggcagaugcugcaugacggaggggucuucuguaucugugca

SEQ ID NO: 4200567 - RNA, 59 nt, Human
ugcacagcagggcauggcuguuguucgcugaagggcagagaagugccuugcugguugca

SEQ ID NO: 4200568 - RNA, 63 nt, Human
ugcacaggguuggccuagucagagacuuuuccugccugucucugacccuagcaucucugugca

SEQ ID NO: 4200569 - RNA, 55 nt, Human
ugcacauaaaguugagacagagauggagacaucucagccucaccucuauggagca

SEQ ID NO: 4200570 - RNA, 73 nt, Human
ugcacauaauccauuugcacugcagacaauuuuaggaugugguuuacaguaagguggaugguaccuuauggca

SEQ ID NO: 4200571 - RNA, 81 nt, Human
ugcacauaguuaccucgauuaaaaaauaaguuuuuggagcuauaaauuuucaaacacugcuuugagagggucugucaggca

SEQ ID NO: 4200572 - RNA, 67 nt, Human
ugcacaucuggcauguaugggcagccacaaacauugucauauuaugcacaugcaugcacagguugua

SEQ ID NO: 4200573 - RNA, 62 nt, Human
ugcacaugaggagaccaaggccugauguuugaacucagccccaauucuccccauucagugua

SEQ ID NO: 4200574 - RNA, 67 nt, Human
ugcacauuauaaacacuaccugucaucauccuaagaaguguggugcaguugauaguuuuagugagca

SEQ ID NO: 4200575 - RNA, 58 nt, Human
ugcaccauauuguuuuaaauaaauugugccacaggccauaugaaacaagaauggugca

SEQ ID NO: 4200576 - RNA, 68 nt, Human
ugcacccugacggugggcagcuugagugucuaaaccuucggcccucaggaggucugcugcggggugca

SEQ ID NO: 4200577 - RNA, 58 nt, Human
ugcacguauggcaguggagcccccauaagccugggcccuugaguggccaugaugugca

SEQ ID NO: 4200578 - RNA, 75 nt, Human
ugcacucuaacaaagagacuacgguggaguuuauagaagcuucuacaacgugguuuuguuguauauagaugugua

SEQ ID NO: 4200579 - RNA, 69 nt, Human
ugcacucugaggagugacuagaggugagcuugaaagggaggccucguguguccuccgguggaacgugca

SEQ ID NO: 4200580 - RNA, 69 nt, Human
ugcacucugggaauccucaccuuccagugaacacaccccaugaggagcaguguggauuccacggcagca

SEQ ID NO: 4200581 - RNA, 63 nt, Human
ugcacugauguuuugccaaggaagcaugacucugguuucaucuggcuaauggcuuugcgugca

SEQ ID NO: 4200582 - RNA, 62 nt, Human
ugcacuuccaaauaccaucacauuguguguaagggcuucagcaugugaauuugggggugaca

SEQ ID NO: 4200583 - RNA, 58 nt, Human
ugcacuucgcgcacaggugccagcuguuaccucgccgggcagcugaccgcgcggugca

SEQ ID NO: 4200584 - RNA, 71 nt, Human
ugcagaaaaacauuuaaagaaauauugugcaaucuccccaguuuggcacaauuuuccuuuaaguguaugca

SEQ ID NO: 4200585 - RNA, 59 nt, Human
ugcagaacgcucccccaggaggcuggcuggcucggccagguuggguggaaguggcugua

SEQ ID NO: 4200586 - RNA, 76 nt, Human
ugcagaacucauggcaucuaccuguguacuuugcgccacaucacaguaaaguguaaaagcauguuagggaguugca

SEQ ID NO: 4200587 - RNA, 59 nt, Human
ugcagaaucuaauguaaaacagacuugcauaaggaugaggucuuauugcaguaguugca

SEQ ID NO: 4200588 - RNA, 62 nt, Human
ugcagaccaagccuuccaggucaucagucaccacguggcccuuguccugggagaguucugca

SEQ ID NO: 4200589 - RNA, 101 nt, Human
ugcagacguggccucugcucuuagagaguuguugaucaggagguagcagauagguagguaaucugaggacauuuuuuucagcagcauaggcaaaaauugua

SEQ ID NO: 4200590 - RNA, 78 nt, Human
ugcagacuaauaaagcagaugcagcuaauaaagcagcuaguugauuugguggcuacauuuguaauauuuuagugagca

SEQ ID NO: 4200591 - RNA, 88 nt, Human
ugcagacucuccucugccugcccaccugggcucuagacugaccaagaccccaccaggcugugggcagugccugacggaugagcugaca

SEQ ID NO: 4200592 - RNA, 68 nt, Human
ugcagacuguaccuggaagagggccugaucucgggaaagacaguuuucuucagccaagguaaucugca

SEQ ID NO: 4200593 - RNA, 59 nt, Human
ugcagagaagaguaucuuuucacacuugaucuguaaaaucaaguugcuuauucugugca

SEQ ID NO: 4200594 - RNA, 63 nt, Human
ugcagagauagaacuacuuucugaugacuuuuuucuguucucuuaaggugguuugucucugua

SEQ ID NO: 4200595 - RNA, 113 nt, Human
ugcagagcuauuguuuuucuaaucucauuguggagcuaagagagagauuguguuuaagguuuccuucguaauagguuuucuugcuccaggaaggaugcgugacagacucugca

SEQ ID NO: 4200596 - RNA, 64 nt, Human
ugcagaguagcuauaccauuuucuacucccaucaggaauauaugaguggucuaguuucucugca

SEQ ID NO: 4200597 - RNA, 92 nt, Human
ugcagaguuccuuuugggugauugcuuuuaagcaccaccuaagcccaucccagcuuagcccuuggaaagcaaugccuagagacauuucugca

SEQ ID NO: 4200598 - RNA, 84 nt, Human
ugcagauggagacaagagggcuaucaaggaggcaacugccaagugagccaaacuucuccuuggucuuugauucuucaucaagca

SEQ ID NO: 4200599 - RNA, 93 nt, Human
ugcagcacuuuuugccuccugacgucacuucuuagucuauuuucugugucuacacuaguaggucagacauaagaggacaaggauguugcugua

SEQ ID NO: 4200600 - RNA, 55 nt, Human
ugcagcagguuccaaaggguuacuuuuagaaaugaacuacccucaaucuccugca

SEQ ID NO: 4200601 - RNA, 69 nt, Human
ugcagcaugguggagcugcucuuuaaauaccgaaaugcacaugcuuaaagacuagaagccguggcugca

SEQ ID NO: 4200602 - RNA, 62 nt, Human
ugcagcccuggaguaccguggccauccagccuguggguggugggcacagugcccaggcugca

SEQ ID NO: 4200603 - RNA, 122 nt, Human
ugcagccuguuugcaggaaucucugggaaagcuauagggucaagcauuugauucacaaauauuuaucaagcgucuacccuuugcgcuguucuucagauaagugauucucaaauuuugcugca

SEQ ID NO: 4200604 - RNA, 61 nt, Human
ugcagccuuggccgugacuccucucugcguuuucccugcaguagugcaugggcgaggugca

SEQ ID NO: 4200605 - RNA, 59 nt, Human
ugcagcuccaugugccgagugcccacagucccagggccuggcacacaaggggugcugca

SEQ ID NO: 4200606 - RNA, 118 nt, Human
ugcagcuccucucauaugcuauuugcaaagucccugggauggaauggacuaauuuuuaaaaugaaaaccuuuccuuuaucuuuccagaggaauuuuuagauagaaauggucugcugca

SEQ ID NO: 4200607 - RNA, 77 nt, Human
ugcagcucuucaggauuuucccaaggcucuggcaauccaauauuuccagcugcccaagaggcauccugcuuggcuca

SEQ ID NO: 4200608 - RNA, 83 nt, Human
ugcaggaaggaggaaccagaggaggaauuaccuuccgucuguggaguagagucccgucuucuggagucugugaccuuccugua

SEQ ID NO: 4200609 - RNA, 59 nt, Human
ugcaggaaguuuccugaacuuuuagaaguugcauuacugaauacagguuaccuuuugca

SEQ ID NO: 4200610 - RNA, 95 nt, Human
ugcaggaauccuuagugaccaauacuguggaugccagcaguggcagugaggauugcugaggucuuugaugguguuggcugcuaaggucuucugua

SEQ ID NO: 4200611 - RNA, 56 nt, Human
ugcaggagaaaguacggagcguuuagcuuuagcuggcauuuuguguuuauucugca

SEQ ID NO: 4200612 - RNA, 58 nt, Human
ugcaggagggaggguuacaguuucuaaaaagagcuggaaagacacugcucugcuggcg

SEQ ID NO: 4200613 - RNA, 78 nt, Human
ugcaggaggucauagcugugcagguagccaaguaccgugcaguacugcaaaugccuugacaguuguaagaccucugca

SEQ ID NO: 4200614 - RNA, 71 nt, Human
ugcaggauugccucaggcuagcuacugucccuuaacuaaaggucacagcuuucucgugaggacucucugua

SEQ ID NO: 4200615 - RNA, 77 nt, Human
ugcaggcaaagaaagguaaauacaugcuuggauccuaugucaaucacaggcacaauuauuucccuuuccauagugua

SEQ ID NO: 4200616 - RNA, 77 nt, Human
ugcaggcagaguaaugaauagaugguggcaggucuuauuagucuccgaaaaaccucugauuuauguugugccacgca

SEQ ID NO: 4200617 - RNA, 55 nt, Human
ugcaggcaguaggccagcuccaggggccacacugcuuucugccggcuguccugca

SEQ ID NO: 4200618 - RNA, 57 nt, Human
ugcaggcauuggugagagaagcagagaauguuagcuuccuccuuacuguuguuugua

SEQ ID NO: 4200619 - RNA, 62 nt, Human
ugcaggcauuucgcaaaggcugagccucuccaggaggcacauuuuuuguagaaguggcuuca

SEQ ID NO: 4200620 - RNA, 63 nt, Human
ugcaggccauucaggagaugugccuuucagagaaggauucaccucaaaagaguggacgcugca

SEQ ID NO: 4200621 - RNA, 58 nt, Human
ugcaggccuggacugaugugguaaugggcagcugaauucggguacucuaggccaggca

SEQ ID NO: 4200622 - RNA, 82 nt, Human
ugcaggguauaauacuuaggugauggguugauaggugcagcaaaccaccauggcacaaguuuaccuauguuauaaaccugca

SEQ ID NO: 4200623 - RNA, 68 nt, Human
ugcagguauggaagaauaauuuugacauuaaagccacgccauucagauuuauuugcucuuuaucugca

SEQ ID NO: 4200624 - RNA, 96 nt, Human
ugcagguggggaugccagaaguucuacaaguggaguucugacgcauuagcuggaugcucagcaaaaagcuugugagagacaacuacaccccgggca

SEQ ID NO: 4200625 - RNA, 82 nt, Human
ugcagucacuccaggccgagucaccuugggucagcgauaccaugugguguccaagaaugagugauuuguccgagggacugca

SEQ ID NO: 4200626 - RNA, 63 nt, Human
ugcagucaucaguccuuuaauuagucucaaauaacagguuaaauaguggauuuggugauuaca

SEQ ID NO: 4200627 - RNA, 81 nt, Human
ugcagucucucagagugcucuagaaauugucagugguuuacauaaaguggccguggguguccagagcacccugaaacugua

SEQ ID NO: 4200628 - RNA, 101 nt, Human
ugcagucuucugccugcugccuguauugcccuucacugcaagcaggacugugcccuacugcugcaagagcuguggcaaaagcagcuggcuaggcagaugca

SEQ ID NO: 4200629 - RNA, 95 nt, Human
ugcagugaauauucugcucucgguaaccuuagaaaaucaaaauuagaaggaaacuuggaugucaucuggggaucagagagugcacagagauugca

SEQ ID NO: 4200630 - RNA, 62 nt, Human
ugcagugcagccgagaucaggugcuauuaggcuacaccugaguacagcugguugcuauagca

SEQ ID NO: 4200631 - RNA, 76 nt, Human
ugcaguggagggugagcucauguuuguguagacagacuugggucugggauguagaaggagcacacugcuccauuca

SEQ ID NO: 4200632 - RNA, 62 nt, Human
ugcaguguggauuuaguugugcuuuuuacuugcugggagagcacagccaccauuuacaagca

SEQ ID NO: 4200633 - RNA, 60 nt, Human
ugcaaguaaauagacugagucaucaccuaggauaagugacagcagucuuaacacauugca

SEQ ID NO: 4200634 - RNA, 61 nt, Human
ugcaaguagcauuuucaaaauguaucucugauggugauuuuuagaauaugcugcauaggca

SEQ ID NO: 4200635 - RNA, 56 nt, Human
ugcaagucccuuguucacuuggagcccauggcugcugcuuggaaauggggcugaca

SEQ ID NO: 4200636 - RNA, 86 nt, Human
ugcaauaauuuguuuucuguuuuaucauuuuuaaaaccuuuguuaucggggagaucaugguggacgggagacaggacuagauugca

SEQ ID NO: 4200637 - RNA, 81 nt, Human
ugcaauagagcagcuaauggaaaggaaaaucuuccaagugauaggaaaaugacauuucacauuggcuucuauuucuaagca

SEQ ID NO: 4200638 - RNA, 78 nt, Human
ugcaauggagauccagaacacaguggaagaauauauugaaauauguguaucuaagguguucuauaaauucucauuuca

SEQ ID NO: 4200639 - RNA, 78 nt, Human
ugcaauucuuaucacaaacaaucuacaaaggauugagauauguuuaaaaucauuuccuggaguuuguggugauaugca

SEQ ID NO: 4200640 - RNA, 56 nt, Human
ugcaauuuuccaacacauuuuuggaacuuccacaauugugcagaauuggaauugca

SEQ ID NO: 4200641 - RNA, 78 nt, Human
ugcaauuuugccuguuauuuguuauuuuuggaauauauguucuauuuuuacuuccuagaauaaguaacaggacaugua

SEQ ID NO: 4200642 - RNA, 64 nt, Human
ugcaauuuuuucccaguuagccaggaacacuuuagagauuccaguggcuuccuggaaaaaagca

SEQ ID NO: 4200643 - RNA, 65 nt, Human
ugcacaacaccaggaagcucauuucacauagaccaugauguagauguguugccuggaguugugua

SEQ ID NO: 4200644 - RNA, 76 nt, Human
ugcacaagaauaugaggaaacugugaaucagcaaauauugcaaagcaauagaaucacaguucucauuuuuuaugca

SEQ ID NO: 4200645 - RNA, 65 nt, Human
ugcacacacaugcagagggagagugagauggccucaugaucuagccacuucuggugugugugaca

SEQ ID NO: 4200646 - RNA, 73 nt, Human
ugcacacccgagcaagauuuuauaaguugugcuaauaauaaguacauguuuuucucugccuggguuuugugua

SEQ ID NO: 4200647 - RNA, 66 nt, Human
ugcacagauagugauagauagcccuaaaauacuuaaguuuugucagugucucucagugucagugca

SEQ ID NO: 4200648 - RNA, 82 nt, Human
ugcacagcagggagcucaggaagaaagaagggaguguguucauaacaauuucuuuccuucuugaaaaccuguuaucugugca

SEQ ID NO: 4200649 - RNA, 61 nt, Human
ugcacagcugccuccucucugcacggaaacggcaguuagaaaaacugagguugccugugca

SEQ ID NO: 4200650 - RNA, 79 nt, Human
ugcacaugggccucugagauaccuuaaagaagcucagcuacuuuuauggcuccuggcagguguuucaaggaaugugaca

SEQ ID NO: 4200651 - RNA, 83 nt, Human
ugcacccagccugauuuugauaauuauaucacuuguuuuugaaaauacacaaggaaauauguagauaucaagaggcauaugua

SEQ ID NO: 4200652 - RNA, 75 nt, Human
ugcacccagugggaugcuuagcauccgggccucgacccucuagauacuccuuuugccaaauacccacugguugca

SEQ ID NO: 4200653 - RNA, 84 nt, Human
ugcaccuuauguuuuacacaguacugcuuugggaugugcaaauacaguguuacucccacacagacuguaaguaucaugagggca

SEQ ID NO: 4200654 - RNA, 55 nt, Human
ugcaccuuguugcuuuuacgaagucugguaagaaugcggugaaguuaggguggca

SEQ ID NO: 4200655 - RNA, 63 nt, Human
ugcacguugaagucccagguugaucugcaugaagcacagcucugacauugauucucagcugca

SEQ ID NO: 4200656 - RNA, 116 nt, Human
ugcacuccuuugcauaguaacaagguugaauauucuccagauguuuuuaagagaauugcuuuuguuguugcuaaggcccuuggaaaaugcaguauuguuagcggcgugggugugua

SEQ ID NO: 4200657 - RNA, 58 nt, Human
ugcacuucaaaaaugucacugagaauucucaaauaagaaaugacauuuccagagugua

SEQ ID NO: 4200658 - RNA, 64 nt, Human
ugcacuugauuuccuaucuuuaugguagaugugccucuaccagaaagauaggaaaucaagugca

SEQ ID NO: 4200659 - RNA, 117 nt, Human
ugcagaaaaaugagaggcaagaggccauucuggaauguaaaguuuaugggccguauugcaaauacaaauagcuucuuuacuuucuagaaauaaauaggucugugucuuuccuuugca

SEQ ID NO: 4200660 - RNA, 57 nt, Human
ugcagaaaaugacaggaagaccaggaaucaagacacuguucucuugcaucuucugua

SEQ ID NO: 4200661 - RNA, 78 nt, Human
ugcagaaagcauugacucuucccccaaggccauucuucuguaucuauuuggcuggcggucaaggucaggcuuucuuca

SEQ ID NO: 4200662 - RNA, 56 nt, Human
ugcagaaagucacauucccuuuagcauuuguagguuuuguggugucucuuucugca

SEQ ID NO: 4200663 - RNA, 92 nt, Human
ugcagaagauguguucugauuuaaucuaggugucaagucuuugaugccauggauuaaguggguggcuuaaauuaaaaaaaaaaauuucugua

SEQ ID NO: 4200664 - RNA, 65 nt, Human
ugcagaaguggcuccaaaaacaaaugacauaaagcaggaacacuuuaguaauggagcuacuugca

SEQ ID NO: 4200665 - RNA, 57 nt, Human
ugcagaauuccuuuugacauguaauguagcauauucacaaguucuagggauuaggca

SEQ ID NO: 4200666 - RNA, 55 nt, Human
ugcagagaugggagugagagcccgucucuuugacauuccaacucacaucucuaca

SEQ ID NO: 4200667 - RNA, 64 nt, Human
ugcagagccagucuugugcuucuaaauuuuacacuauuuuacaggugccuaucuggucucugca

SEQ ID NO: 4200668 - RNA, 57 nt, Human
ugcagagcuguuaauggagcugaaucugauuuguguuuagccuguaagcacuuugca

SEQ ID NO: 4200669 - RNA, 64 nt, Human
ugcagagcuucauugcauaggcgucuuuuaguggagaaaacaguuacuauggugaugcuuugua

SEQ ID NO: 4200670 - RNA, 55 nt, Human
ugcagaggugcucaguggcagaaaugaaaucauuccagggcucauucccucugca

SEQ ID NO: 4200671 - RNA, 62 nt, Human
ugcagagucccaggacccagagacuuaccuauccaccccacucucaacaccagggcucugua

SEQ ID NO: 4200672 - RNA, 68 nt, Human
ugcagaguucagcccuacccauucccugggcagggccccuggcuggcugggugggcagagucucuuca

SEQ ID NO: 4200673 - RNA, 66 nt, Human
ugcagaucaaaguucguaacugauaaccaguuaauggaugagaagagacgaggcuuuguuuuagca

SEQ ID NO: 4200674 - RNA, 80 nt, Human
ugcagaugaauauugaaacugcaaccugggguaucgaagcuuccauuuguuguguauuaauauugcuauuuauuucugca

SEQ ID NO: 4200675 - RNA, 76 nt, Human
ugcagaugucaucaggcuaagacacuggcaaggaggaugggaagcuaggguggagagacuagaugacaaugaugua

SEQ ID NO: 4200676 - RNA, 68 nt, Human
ugcagauuaccuuggcugaagaaaacugucuuucccgagaucaggcccucuuccagguacagucugca

SEQ ID NO: 4200677 - RNA, 66 nt, Human
ugcagauucuugggccucccagaaguucugguucacuaggucugggacaggacuggggaacuugca

SEQ ID NO: 4200678 - RNA, 106 nt, Human
ugcagauuguauuuugcauaguguguaaugccaggggcugcuauucacauagguuauaagaaugccaccccauggaguuguacgguguguugccugcauaacugca

SEQ ID NO: 4200679 - RNA, 69 nt, Human
ugcagcaaauaaagacaauuauguccuguguaguauauaagauauauacaacauugcuuuguugcugca

SEQ ID NO: 4200680 - RNA, 130 nt, Human
ugcagcagagcaucaccuagcaacuuguuagaaaugcauaugcccuggccucaccucagacuuacugaaucagaaacucugaggauggggucaagcaguuguaauaagccuuccaggugauucugaugca

SEQ ID NO: 4200681 - RNA, 78 nt, Human
ugcagcagccucaucugguuucuuauuauuuccauuuuauauauauaaggaagcugaggcacagagagguuaaaugca

SEQ ID NO: 4200682 - RNA, 57 nt, Human
ugcagcagggcccaggcacagagcaccaucucuuccugucaacaaggccccacugua

SEQ ID NO: 4200683 - RNA, 63 nt, Human
ugcagcauauagcuuagugauggcagaagguaaauauuuaggcagcacaagcuguugauugca

SEQ ID NO: 4200684 - RNA, 56 nt, Human
ugcagcauccauauauuauuagacugagcuuuucuaauagggauaaacgugcugca

SEQ ID NO: 4200685 - RNA, 107 nt, Human
ugcagcaugcaggagaggcucuggugcagcaugcaggagaggcucuggugcagcaugcaggagaggcucuggugcagcaugcaggagaggcucuggugcagcaugca

SEQ ID NO: 4200686 - RNA, 76 nt, Human
ugcagcccccaggagaaaucuuaaacuagagaucuugccaaaccuccuggagauuucucccugggggaauuuugca

SEQ ID NO: 4200687 - RNA, 55 nt, Human
ugcagccuguccaggcccagaauguccuuaacucggcaucuccaggacgagcuca

SEQ ID NO: 4200688 - RNA, 62 nt, Human
ugcagcgcggccguguugucacugugcagcagugcgugcaggaaggcgcggcugugccugua

SEQ ID NO: 4200689 - RNA, 63 nt, Human
ugcagcuguguaaugagcccacaucuguuaccaccacauguugcucagcgcuacgcagaugua

SEQ ID NO: 4200690 - RNA, 71 nt, Human
ugcagcuuuagauuuucuuuuagcccaagcugggggcucauguuugguguugaacaaaacuaaauguugua

SEQ ID NO: 4200691 - RNA, 62 nt, Human
ugcagcuuucuaagcuuuauugcacgggauuuggaaacuugagccuagagauggaaggcgca

SEQ ID NO: 4200692 - RNA, 55 nt, Human
ugcaggaacuugguuuuacucagaacaaaagcgauguggaauaaagucuucugca

SEQ ID NO: 4200693 - RNA, 95 nt, Human
ugagcucuuccugcagauggcacugguguuacuuggauaaagaacauuuuuguguucagcagcuuuuaguacauugugcacacuggaaaggcuca

SEQ ID NO: 4200694 - RNA, 97 nt, Human
ugagcugcuaagagguggcccagccuauuuuaugguacuguaaauauugcgaauuuagagaaccaaugaauagucuugcuaccuaugcauuagcuua

SEQ ID NO: 4200695 - RNA, 63 nt, Human
ugagcugggaagagcagccagagggugucuccuuauuucugguccacuauucuuuuuacuuca

SEQ ID NO: 4200696 - RNA, 83 nt, Human
ugagcugggcagggccagagagggcuggcuggggucucugccacuccuaagcccccucacccuggcuuccccugcagugcuca

SEQ ID NO: 4200697 - RNA, 63 nt, Human
ugagcuguagcagaugcuguugaugccuuagucacuugggcagcaagugucagcugcagcuca

SEQ ID NO: 4200698 - RNA, 56 nt, Human
ugagcugugugacauugagccauccuuaugccaugccucaguuuccucauggcuca

SEQ ID NO: 4200699 - RNA, 85 nt, Human
ugagcuuccgguuuauaaggcccaauauuucuuuccuuucucaaauauaaagaaauaugagucuuauagaagcaaaagaaguuua

SEQ ID NO: 4200700 - RNA, 83 nt, Human
ugagcuuggggaagugggucagggacagaucuugcaagguugggauguaaucugauuucugauuuauuucauaagaaggucca

SEQ ID NO: 4200701 - RNA, 55 nt, Human
ugagcuuucauguaugaaaagacugucaaaaacagaucauucaugcuggggcuca

SEQ ID NO: 4200702 - RNA, 73 nt, Human
ugagcuuuguuguuaguauauuugcauuggagcccauggaaugaaauauauauuagcaauccacagagacuua

SEQ ID NO: 4200703 - RNA, 71 nt, Human
ugaggaaaggcaugugggcugguuguacaguagugaugcuggauuugcaaugaggcaacaguaauuucuca

SEQ ID NO: 4200704 - RNA, 58 nt, Human
ugaggaagaacaagaauuuagagaugggucugauuccagaaucuaguguucuugcuca

SEQ ID NO: 4200705 - RNA, 59 nt, Human
ugaggacauuaggaagugaagggcaggaagaagcaaaucuuagacuguuggugucuuca

SEQ ID NO: 4200706 - RNA, 84 nt, Human
ugaggaccccugcacuagagaagggcacagucucauaaagcagauccugagacuaaagacucauucugcugcugggucacugca

SEQ ID NO: 4200707 - RNA, 95 nt, Human
ugaggacuuggcuuugcagaggaccauuguccuggagacaguccugacccugguuuccaggagguugagugaguuccuucaugguaaaguuuucg

SEQ ID NO: 4200708 - RNA, 121 nt, Human
ugaggagaaaaugagaguacagaaugguauaugccagaagccaaaaaauauucucuguaaaggaccaaacaguaaauauuucaggcuucuugggccagauggccucuguuguaacuccuca

SEQ ID NO: 4200709 - RNA, 76 nt, Human
ucggagccggcccugcccucucggcacucgcgguccggaccaggaaggcggcccgagcaggacgggugggcugcgg

SEQ ID NO: 4200710 - RNA, 77 nt, Human
ucggauaaucucagagauaucuguguccuacacagcaggguucuguaaggggcacauggauaccucugagaagcuga

SEQ ID NO: 4200711 - RNA, 62 nt, Human
ucggauccuuggauaacgcaugaauguuucaggcaucagaugguacuaauuuaaggaucugg

SEQ ID NO: 4200712 - RNA, 66 nt, Human
ucggcauacguggaaguaucugugaccucauuucuaugaacucaaacugcuuaccaucugugcugg

SEQ ID NO: 4200713 - RNA, 84 nt, Human
ucggcccccugcugacgcagugcccgccgccguuccuggaugacuucaguggugaaguggugcaccaugucacaggccugccgg

SEQ ID NO: 4200714 - RNA, 74 nt, Human
ucggcuccugugaggacacagccgccgggcccaggaggucacgugcaagcugugccuucucaggauagagccga

SEQ ID NO: 4200715 - RNA, 60 nt, Human
ucgggcuccaggcagcugggaguagccggagccggcuucccuccugguccaggagccuga

SEQ ID NO: 4200716 - RNA, 59 nt, Human
ucggggcucuucugcucgcuuuuuuuccucuucagaaauuaaagcagaggagcaucuga

SEQ ID NO: 4200717 - RNA, 77 nt, Human
ucgggucuacuccuccuaaaugauucuuccuguauguuuuacgugggggucgaggggauaggagaggguggcccuga

SEQ ID NO: 4200718 - RNA, 108 nt, Human
ucggugcuucccagagaccccucugagcuggccuguggggcacgggaagcccccuggaugggaggcggggccacaggucggcuagagggucuccaccaggcccacuga

SEQ ID NO: 4200719 - RNA, 73 nt, Human
ucgguggacgccggggccuaccgcugcguggcccgcaaugccgcgggccacacggagaggcuggucucccuga

SEQ ID NO: 4200720 - RNA, 74 nt, Human
ucgguugccaggcaacugcccagccaucuaugacagaggaauucccucagaggagggcgccaccuggcggcuga

SEQ ID NO: 4200721 - RNA, 83 nt, Human
ucgguuuccacaccuguacagggccgggcuggcucacaaacuuccugggccucgguuuccacaucuguacagggccgggcuga

SEQ ID NO: 4200722 - RNA, 109 nt, Human
ucgucaacauuacucgacagauguggcaccgaucuuuagccagagaacucucuggaaccaucaaagagauccuggggacugcccagucuguaggccguaauguugaugg

SEQ ID NO: 4200723 - RNA, 91 nt, Human
ucgucuuaugauguugcauauggaccaacuucuuaauugauaaauauugauaaaguuacuguuucauugagacuauagacaucagaaucga

SEQ ID NO: 4200724 - RNA, 62 nt, Human
ucgugaugcaguguccucccaugcacagugauucucaguucauggacccaacauugcuauga

SEQ ID NO: 4200725 - RNA, 69 nt, Human
ucgugcacagucaacacuuauucaccaucaggcaauccaugguguagggaaacuugacuaauguaauga

SEQ ID NO: 4200726 - RNA, 75 nt, Human
ucgugugacagaagcaaggucugucaguauauucaaaauauauguuauauuuuaaucuuguuuucuguuuuauga

SEQ ID NO: 4200727 - RNA, 78 nt, Human
ucgugugggaaaugggaggucugagccgugggggguguucuccagcccauggcucuuaccuuguuauaaucucacuga

SEQ ID NO: 4200728 - RNA, 65 nt, Human
ucguguuugcaaauuauguuaaaaguaaaggaauacuuuuuucuuaaaugauuuguaguccaugg

SEQ ID NO: 4200729 - RNA, 78 nt, Human
ucguugguacauguuaaggaagaguaauaccaugauguaauccuacucuuccuuaacauguguguuuuaagccuuuga

SEQ ID NO: 4200730 - RNA, 66 nt, Human
ucguuguucuucuucuuguucaaggcuacagcuuuaacuuugucacagcaagaguaaggacagcga

SEQ ID NO: 4200731 - RNA, 62 nt, Human
ucguuuagcugggcacauucagaauuuucucuuuuauugagcaacugugcucugcuaaauga

SEQ ID NO: 4200732 - RNA, 81 nt, Human
ucguuuaucagaauguuauuguguuuguucagggcaaaguugcuuuuagaugggcaggauaguguugaauuugguagagga

SEQ ID NO: 4200733 - RNA, 56 nt, Human
ucguuuggcugaagcuacaucagcaggugcaucugcuggcugaaacagccaaagga

SEQ ID NO: 4200734 - RNA, 79 nt, Human
ucuaaaaaucucuacuuugggucagauaagcggguaaauuagcuccacuuuauguccuugaagaguugugauuuuagga

SEQ ID NO: 4200735 - RNA, 62 nt, Human
ucuaaaagccgugagucucuccccugggccucuagaagcagcaggacucaugguuucucaga

SEQ ID NO: 4200736 - RNA, 96 nt, Human
ucuaaaauguucuauaaaaggucagacagggugucuuucucugauuccaucaggccucugggaagaaccucugcuaccaauuaugugcuacuugga

SEQ ID NO: 4200737 - RNA, 98 nt, Human
ucuaaaauuuaagaagcacuguauuccuacuagaaucuagaugauucauagaaucuagauuauucuaaugggaguucaccgcuucugaaucaacuaga

SEQ ID NO: 4200738 - RNA, 68 nt, Human
ucuaaacacuaagucuugaugcucauuuuuguguucacauuggaaaaauaucuggauuuagguuuuga

SEQ ID NO: 4200739 - RNA, 79 nt, Human
ucuaaacagcaaauuugaaugagaauuauugucauuuugucacugaugagcagaacuaauuuuuuuucacuguuaugga

SEQ ID NO: 4200740 - RNA, 128 nt, Human
ucuaaauaaaggauuauauuagcuaaaaacgauugaacuugagauaugaguagguaccuuucuaguaucugguuuuguuacagguucuuaugguugauuuucugccuguaauguaguauuuuaauaga

SEQ ID NO: 4200741 - RNA, 72 nt, Human
ucuaaaucccaacaugauaucaggagcuucuacaugcgcuuuguaagaauggugucuggugggaguuuuaga

SEQ ID NO: 4200742 - RNA, 85 nt, Human
ucuaaauuuaaauacuaaaugauuaagcaggaauuuacgucaaaaagcuugaaauuccuguuauuuauuuggguaaacauuugga

SEQ ID NO: 4200743 - RNA, 65 nt, Human
ucuaacacuguuauuaaacugcucucuuuuguuagaaaaggugcuguuugucagcaguuuguaga

SEQ ID NO: 4200744 - RNA, 91 nt, Human
ucuaaccaaguugcugggaaaauucagagagcuugcauuuaauucccaaggcaagcuuuaugcuacgauuucuaguuuuaacaagguuaga

SEQ ID NO: 4200745 - RNA, 63 nt, Human
ucuaaccuuuuuaucuuaccuccagcuagugaaacuccaguuagauagaugagaaguguuaga

SEQ ID NO: 4200746 - RNA, 69 nt, Human
ucuaacuauacaaagaaaacauuuagauuucaauauuuuucucugugugugugucuggguguguguaga

SEQ ID NO: 4200747 - RNA, 58 nt, Human
ucuaagcugaccacauggccaagccaugugucaugauguggaguuguggcaguuugga

SEQ ID NO: 4200748 - RNA, 129 nt, Human
ucuaaggacuccuccugcucaaccacauccacuggucgggguccacccaggccaagcacagagcugcggaggggcugagguggccucugccggggaauggaaaacggcucucuuggaggaacugaagga

SEQ ID NO: 4200749 - RNA, 76 nt, Human
ucuaaggccuugaggauagaacaucccucauccuagcaggaaauaaugaaaccuucuaaccuuaaagcccuuugga

SEQ ID NO: 4200750 - RNA, 63 nt, Human
ucuaagggaaaucuuucaacacuucauuguuaaggaugauguuugcugaagguuuuugguaga

SEQ ID NO: 4200751 - RNA, 113 nt, Human
ugcaggacacuucgggaugugggucacauuuuguccuggaaucaguacuuaccagcuuagucugaggccuugggacagaagugcugcucauaaaaguaaauuguguuucugca

SEQ ID NO: 4200752 - RNA, 63 nt, Human
ugcaggagcccaggaauacuaugcgacacuugauacuagcccugaguauuggcagguccugua

SEQ ID NO: 4200753 - RNA, 127 nt, Human
ugcaggcaaagcuccaauaccucagcggggaaugcuuggagccaaaaugacaugagagugaaguuucucuuggcuccucacagcaucagugaacucucagcugaugggguaagggaggugguuugca

SEQ ID NO: 4200754 - RNA, 71 nt, Human
ugcaggcaauuuccaucauccuaacgagaaagcaguccaagaguguuuucugccgguggugggcuccugca

SEQ ID NO: 4200755 - RNA, 57 nt, Human
ugcaggcagggccagcgugaggucaggauuaaccagagaagcugugcucuucuugca

SEQ ID NO: 4200756 - RNA, 57 nt, Human
ugcaggcuagagugaagacaaauuacuugagaaaagugguuugauucaguuuaugca

SEQ ID NO: 4200757 - RNA, 66 nt, Human
ugcaggcucugagugaagggggccuccucauuggagugugcaggggccuccucauuggagugugca

SEQ ID NO: 4200758 - RNA, 76 nt, Human
ugcagggcuggaggagaaugggugugagucuagggucagcucaggcagcauuaaacuucagcagcuuauuccugca

SEQ ID NO: 4200759 - RNA, 76 nt, Human
ugcagggugccaagcaaugauuggaacaugaaagcuauucaaugcauaucagugauuguuugcucuucauucugca

SEQ ID NO: 4200760 - RNA, 62 nt, Human
ugcagggugguuugaagggucugggaacuggaggugaggccagaaccuuggaugccauugca

SEQ ID NO: 4200761 - RNA, 63 nt, Human
ugcaggucacguuuuuugguuugaguccacaagacucugacaaugcugaaggaggugccugca

SEQ ID NO: 4200762 - RNA, 57 nt, Human
ugcaggugauucugaugcaguuuccaguuugagaaccacugcuguagaccaucugca

SEQ ID NO: 4200763 - RNA, 61 nt, Human
ugcaggugucugggggcaacagagucuaggauguggccacaagugucccauggacauggca

SEQ ID NO: 4200764 - RNA, 93 nt, Human
ugcaguaaauguuuuauggcuaucuugcagccaagggcagcugacaugaagaagcaagggacuugcaaauagccugaugaaagaauuucugca

SEQ ID NO: 4200765 - RNA, 59 nt, Human
ugcagucaggagcugcugcauuguaagucaucuuacaguacagucuagacucuggagca

SEQ ID NO: 4200766 - RNA, 61 nt, Human
ugcagucuuuccucgaguuuguuuggagaaagcagcaaacguaugaaaaggaaaaacugua

SEQ ID NO: 4200767 - RNA, 64 nt, Human
ugcagugagguggauggauggccuggccuguuggcaagggcagaaaucgauuacaccucuugua

SEQ ID NO: 4200768 - RNA, 62 nt, Human
ugcagugaugcuguacagggcagccaggccccuccuaggccagcugcucuccacggucugca

SEQ ID NO: 4200769 - RNA, 62 nt, Human
ugcagugguugagagcccagacucaaaacguagacauccuggguuugaaucuaccacuugca

SEQ ID NO: 4200770 - RNA, 62 nt, Human
ugcaguguggauuuaguugugcuuuuuucuugcugggagagcacggccaccauuuacaagca

SEQ ID NO: 4200771 - RNA, 68 nt, Human
ugcaguguggccaugucagcuauguggcagagaccuagauucacuaguagugugacaggcuaacugua

SEQ ID NO: 4200772 - RNA, 55 nt, Human
ugcaguguuccaggcggcagugaacugcauucaccuccuguuugggagcauggca

SEQ ID NO: 4200773 - RNA, 69 nt, Human
ugcaguuacacagccagggagggacagaagcagaaucugaaccucugcagccuggcugugaagccugca

SEQ ID NO: 4200774 - RNA, 68 nt, Human
ugcaguucucucaagauucagaaaguauggauaccuuugccaugccuggcagcuugaaagaaauagca

SEQ ID NO: 4200775 - RNA, 93 nt, Human
ugcauaaaauaacuuggauauucaagugaggauggcuaauccaaacaaugcuuagcauucucauuugcauaaagagcuuugaguucauaugca

SEQ ID NO: 4200776 - RNA, 65 nt, Human
ugcauacugauugggaguuuuguucuaugcauugcagggagcugaguuaccuccagaucauagua

SEQ ID NO: 4200777 - RNA, 58 nt, Human
ugcauagguucucucagaaaaguuuuuuuucccacuuaguuugaugagaauuuaagca

SEQ ID NO: 4200778 - RNA, 120 nt, Human
ugcauagucagcugugaaauuauuuuucuuucuugaaaucuagcuuagguccacagcuauauucuguuaccuaaauucuggcugauuaggcaggaaggaaaugauuucauucugaaggca

SEQ ID NO: 4200779 - RNA, 62 nt, Human
ugcauaucuucaaugcuguugcuauguuguauucuucuauugcaauacacuguagaugugca

SEQ ID NO: 4200780 - RNA, 94 nt, Human
ugcauauguauaugcauauguacuugcauauguauuugcauauguacuugcauauguauaugcauauguacuugcauauguauaugcauaugua

SEQ ID NO: 4200781 - RNA, 70 nt, Human
ugcaucaaaagaauacccugggucauaaauagcagucauuaauugcagcugcuuuuacaccuaguaugca

SEQ ID NO: 4200782 - RNA, 86 nt, Human
ugcaucaguguuuuugguuccuaagaccaaaggaugacucuaauccuucaaaaguugagagagccauguuguuaggcauuggugca

SEQ ID NO: 4200783 - RNA, 76 nt, Human
ugcuccuggcuagauguguggccaugaagagguuacuuacuccuuugaagcccaaguuccucaucuugcuuuugca

SEQ ID NO: 4200784 - RNA, 100 nt, Human
ugcucggucacccaggcuggagugcaguggcacaaucuuggcucacagcaaccuccgcugccaggguucaagcuauucuccagccucagccucccgagca

SEQ ID NO: 4200785 - RNA, 86 nt, Human
ugcucuacucggcgccucuccauggggcuacggcaaggcuugcugccuacgagcagaauggagggugccgaguucuccuagagaca

SEQ ID NO: 4200786 - RNA, 75 nt, Human
ugcucuggacuugagauguguuguuaaccuggcugguaagacagguucuuaaguaacagcacaccuucccaggua

SEQ ID NO: 4200787 - RNA, 97 nt, Human
ugcucuggcaaaaccuuuucaguugaucauuaucaaacuggucauguuucaaagauaaugaucaggaugauuagugcuccagaaacugugccaugcg

SEQ ID NO: 4200788 - RNA, 65 nt, Human
ugcucuguuaugucucuguaucacaaagggucacagcuaagguaaaacaggggcuagcggaagca

SEQ ID NO: 4200789 - RNA, 69 nt, Human
ugcucuguugguuauuugggaugcaaggaacagcuguauacagucugucagucauucuaacaacaggca

SEQ ID NO: 4200790 - RNA, 101 nt, Human
ugcucuuacugcacuucaugcaaauuugccagaucaauucugaaaucauuuuagaucagcaguauaaaugagcaagugcaugaauuguagaucuuugagca

SEQ ID NO: 4200791 - RNA, 62 nt, Human
ugcugaaauauuuauggguaaggggucacgaugucugcaacuuacucacaaaugguuuagca

SEQ ID NO: 4200792 - RNA, 83 nt, Human
ugcugaaauguccuggcacuuccacuuugcuuuacuguaagccaucuuccaguccaggccuggaggagccaucuaucucacca

SEQ ID NO: 4200793 - RNA, 73 nt, Human
ugcugaacuacuaccaguaguaguaguaguaguaguaguaguaguaguaguaguagugguaguaguaguagua

SEQ ID NO: 4200794 - RNA, 55 nt, Human
ugcugaacuauuccauggggaaguuucugcaaucuucauuccaaauaguucagca

SEQ ID NO: 4200795 - RNA, 73 nt, Human
ugcugaagauuucaccaguggaaaagaugucucaguaaaggagaugauuuuugccagugugaugauucaggca

SEQ ID NO: 4200796 - RNA, 72 nt, Human
ugcugaaucccucucuuccuggagucagagucaucagacauucuggagccuuggaugggaaagaauuuagca

SEQ ID NO: 4200797 - RNA, 116 nt, Human
ugcugacaaguuuccuuaauugauauuaaaguucgucauucaauaaagaaaccauucuaaggcaauucaguguggaaugugaacugcagugaacacagacaagaaauuaaaaagca

SEQ ID NO: 4200798 - RNA, 57 nt, Human
ugcugacacuauucuaaaaagcagauaauuuugguucugcuugaauaaugaauagca

SEQ ID NO: 4200799 - RNA, 76 nt, Human
ugcugacaggccaggggcugagguggccuuuccugacagcccaggauuucccuuaagccacugaccuccaaaagca

SEQ ID NO: 4200800 - RNA, 66 nt, Human
ugcugaccugcucucagcagagaggaaauggccucccucccaucuuggcugcagagccggcaagca

SEQ ID NO: 4200801 - RNA, 59 nt, Human
ugcugagagagguacucagggaagacaagccaacuagccugggugaaaucucuccugca

SEQ ID NO: 4200802 - RNA, 63 nt, Human
ugcugagaggaaggugcacuggggcagggacuacauaaaauuccagcgcccccauucccagca

SEQ ID NO: 4200803 - RNA, 60 nt, Human
ugcugagaugcugggaugucgacaggcgugagauucuguccaucacuauuaucuacaaca

SEQ ID NO: 4200804 - RNA, 55 nt, Human
ugcugagcaacguggagaguuuugaagagauugaaaaugguucguuugcucugca

SEQ ID NO: 4200805 - RNA, 56 nt, Human
ugcugaggcauuuggacagagugagaaaucaugucauguuuucaguguuucuagca

SEQ ID NO: 4200806 - RNA, 56 nt, Human
ugcugagggagcaucaaagaaaggagaacuugccccuuuauuuggcuguuuuagca

SEQ ID NO: 4200807 - RNA, 88 nt, Human
ugcugagggcccuuacgcaggcccuuccccauucuaggcucaggcuugccacugauaaugaagggcuuggcugggaggccacucccca

SEQ ID NO: 4200808 - RNA, 102 nt, Human
ugcugaguccuuuacaagaugcaucauuagcacaugacggaaagcaauuaacuugcuucuuacucauaugcugaucaaguugcaacuggaaaggaguuugca

SEQ ID NO: 4200809 - RNA, 65 nt, Human
ugcugagugcuugcuauuuguuagguuuuggucuagguccuagggauacagcagaguacaaagua

SEQ ID NO: 4200810 - RNA, 55 nt, Human
ugcugaguggcauggagugcuuagauaacaaugagcuccaugacuugaauuagua

SEQ ID NO: 4200811 - RNA, 59 nt, Human
ugcugaguggcggccucacuuuuaugcauuauaccagauaugugaggguucacucagca

SEQ ID NO: 4200812 - RNA, 130 nt, Human
ugcugaguucuaggauugacaguucgagcuucaguauaaaaacugaguaccucugcauucauucgaugaugaauaaugcagggcggcuuguuuauuugcuugcucugaaaucuuauccuguuuuucagca

SEQ ID NO: 4200813 - RNA, 114 nt, Human
ugcugauggauuucaagcagacagcaagacaaggaacaaacuguggugauuagcauugucagagcaguuuugaagugcuuguuuuguacuuuucuuuaucgguccuaaucagca

SEQ ID NO: 4200814 - RNA, 55 nt, Human
ugcugauguccuaguucuggucucuuacuucauagaucuagacuugggcccagua

SEQ ID NO: 4200815 - RNA, 73 nt, Human
ugcugcaauuaagauuuagagaaaaguaugugcuuacgucuauuacguauuacaaauaaauguuacuguagca

SEQ ID NO: 4200816 - RNA, 61 nt, Human
ugcugcacaauuggaaaguaucacaugagauacuucuaagacaauauucagcugagcagua

SEQ ID NO: 4200817 - RNA, 60 nt, Human
ugcugcagaaauucugugaggauggaugccuccuaauccuugccuucagcucugccagua

SEQ ID NO: 4200818 - RNA, 64 nt, Human
ugcugcagcugcugguuuaagggauggguuauucaagggcccaucucccaccagcugcuuugca

SEQ ID NO: 4200819 - RNA, 59 nt, Human
ugcugcagugggauuagccugaagaauccuucuauguccccguuauucucucugcagua

SEQ ID NO: 4200820 - RNA, 56 nt, Human
ugcugcauagcagcuccugaaauuaguagacacuuguuuggaagcuguguguagua

SEQ ID NO: 4200821 - RNA, 65 nt, Human
ugcugcaucguugagcauuugcuacacagagaauaaccuuggagcaauguucaaaggugauggca

SEQ ID NO: 4200822 - RNA, 86 nt, Human
ugcugcucuucaucugacuggguuaaguucauguagagaagggaucugaaacauuucuacauagcuccuagugaugcaugcaugca

SEQ ID NO: 4200823 - RNA, 92 nt, Human
ugcuggagaucuuucaugcuuuuccuaaaaugaugccucugaggugaggugaccuacauguggaaaauaccgcacugaaaguuuucuuuuca

SEQ ID NO: 4200824 - RNA, 56 nt, Human
ugcuggcaaaggcgcucacaugccugcagaccgcaggugaagggccuuugguggca

SEQ ID NO: 4200825 - RNA, 84 nt, Human
ugcuggcauugguucaguagcucuaaacugugagaacuuacuugcugcuuuguuuucacaagacagcuacuguugcuccagaca

SEQ ID NO: 4200826 - RNA, 56 nt, Human
ugcuggccauagaagccaaagagggaugcaucugucauuucucuucuggguuagca

SEQ ID NO: 4200827 - RNA, 61 nt, Human
ugcuggccugagggcuccuagcaggcugccucugcagccuggccacucagggccugaggca

SEQ ID NO: 4200828 - RNA, 69 nt, Human
ugcuggccugggugcugcugacaucuggccauacuccacccagauagcucugcuccccagagcccugca

SEQ ID NO: 4200829 - RNA, 57 nt, Human
ugcuggcucaagcugauaagagaaaauauguaagaguguuggcuucuugagcuaaca

SEQ ID NO: 4200830 - RNA, 59 nt, Human
ugcuggcugugauuuugccaacagagauaaaauucgugcuggcuguguuauugccaaca

SEQ ID NO: 4200831 - RNA, 63 nt, Human
ugcuggcuuuuccuaaacugggaaguauagauccacaaacuacuucaucagcaaagcacagca

SEQ ID NO: 4200832 - RNA, 63 nt, Human
ugcugggcaaauugugccagcuauggguaucaauuuuauagcuuaucccacagugcccagaca

SEQ ID NO: 4200833 - RNA, 65 nt, Human
ugcuggggccugagguggagcugcagacucugacugaggugcaggaggcuuuauucaggauagca

SEQ ID NO: 4200834 - RNA, 64 nt, Human
ugcugggucagugagagcagggaguaugccagacaagagagcuuccugcggccacaagccugca

SEQ ID NO: 4200835 - RNA, 95 nt, Human
ugcuggguucucaggguuagguagggacucugccauuucuuacugucaaaaucucuccuguggagaugguguuccacugccagucuagcucagca

SEQ ID NO: 4200836 - RNA, 80 nt, Human
ugcugguggugcuggagcucuguguguuccugagccgcugucugcucgguguuuucaggcggagcucugggccccaugua

SEQ ID NO: 4200837 - RNA, 55 nt, Human
ugcugguuagugcugccuggguaaagggagcugggcccaggcagagcuagcggca

SEQ ID NO: 4200838 - RNA, 111 nt, Human
ugcugguucauacccuucccuccucagggcugguuacauggauggcucccaaccuaaacccccccaugccagcugcuaggucacagggaucucuggaggguguaacgggca

SEQ ID NO: 4200839 - RNA, 55 nt, Human
ucugcaggguuuuaacaauggacaaggaguuuuuucugcagucuggcccuauaga

SEQ ID NO: 4200840 - RNA, 80 nt, Human
ucugcauaauaggugcuugaggaacggaggcuguguguuucugcacgccagcccagugcauuuguguacucacauguaga

SEQ ID NO: 4200841 - RNA, 57 nt, Human
ucugcauguuggcauccagguguauuauuauuccugugugguagccagcggugcaga

SEQ ID NO: 4200842 - RNA, 57 nt, Human
ucugccacaggcagcagaaaacaaaugguugggauucccaucuuugccaguggcagg

SEQ ID NO: 4200843 - RNA, 58 nt, Human
ucugccacuuagccagaaguccucagacaauuuauuagagugcucaguuaaguggaga

SEQ ID NO: 4200844 - RNA, 78 nt, Human
ucugccaggcuguggcuccaggaaggcccucugccaggcuguggcugagaguggccuggccuggggcauggcugcaga

SEQ ID NO: 4200845 - RNA, 121 nt, Human
ucugccaucuagcugcccugcguauugccugccaguggguaguuggagcuggguaucucuccaaagcugggcucuuggcugcccuuugugaaggcaauuuuaagggacagcaggaugugga

SEQ ID NO: 4200846 - RNA, 75 nt, Human
ucugcccaugggugggggcuggaaaucuugccaggauuuguggccagaaaauggucccccauggccagggacaga

SEQ ID NO: 4200847 - RNA, 60 nt, Human
ucugccucucggcugccgaguucccacaggcucugggagacugaggcugccagggucaga

SEQ ID NO: 4200848 - RNA, 78 nt, Human
ucugccucuuuucuguaugugagagcagagaaucgucacugacagccucucccaggucauacacagagaggaaguaga

SEQ ID NO: 4200849 - RNA, 77 nt, Human
ucugccuggagaguucuucucugcccucugagccuggugagcuggagaacacccucagagaggagccccauggcaga

SEQ ID NO: 4200850 - RNA, 103 nt, Human
ucugccuggcaugaacacuucuauuucagcacaucugugauugccauaucaccagcauuugcagaaauggaggauuaauuuuauugugcauuagcucagcaga

SEQ ID NO: 4200851 - RNA, 75 nt, Human
ucugccuuaccucuggggcagucugacacuauggaauacucuggucaggcugaacugccacaaagguugggugga

SEQ ID NO: 4200852 - RNA, 61 nt, Human
ucugccuuggaaauuucaacagcgugcauucuaggcagccaacaugaaagaaucagggaga

SEQ ID NO: 4200853 - RNA, 59 nt, Human
ucugccuuggauuuguuggcccaggucccaugggugcugugggccauggccaagugaga

SEQ ID NO: 4200854 - RNA, 70 nt, Human
ucugccuuuucacugccacuaagagagggguagcauucaaugagcagauggcaguggcucagagugcaga

SEQ ID NO: 4200855 - RNA, 77 nt, Human
ucugcgcuuuagcacccuagaguugccugaggacucauuggguucguagggcuuaguggggcuagcuagaaugcgga

SEQ ID NO: 4200856 - RNA, 114 nt, Human
ucugcggcuuggcugugcuuauuuggccaaacagguccccuccccuaccaggcuuccugcuggggccuugggaacaggggggacuucuggaccaaaucagacaauuguuguaga

SEQ ID NO: 4200857 - RNA, 61 nt, Human
ucugcgguccccuucucgcccuccacacacuucucucggggcugaguugggggaucgcgga

SEQ ID NO: 4200858 - RNA, 65 nt, Human
ucugcuaauuucugcuauuauucugcuaauuuuugcagaaacuagauuugcagaaacuagacagg

SEQ ID NO: 4200859 - RNA, 78 nt, Human
ucugguuguggaguuucaggauuguguuuuuccugacaguugggucaggaaauuaaacacuugaaagcacagagcaga

SEQ ID NO: 4200860 - RNA, 84 nt, Human
ucugguuuaaccuaauaccuagagaugauacaaaucucauuuuuguuuguuauauuuugguguuguagguggguugaaaauaga

SEQ ID NO: 4200861 - RNA, 119 nt, Human
ucugguuugcagauggcugucuucuagugugcccucacaaaguggaaagagagaggaaguaagcccucugugucuuucccuguaagggcacuaaugagggcuccaccuucaugaccuga

SEQ ID NO: 4200862 - RNA, 63 nt, Human
ucugguuuggacuuccuugagaaagugggaaacagucacacauugggaugaagucuaaaaaga

SEQ ID NO: 4200863 - RNA, 111 nt, Human
ucuguaacuauguguuaaaaugucugaguucucugauuuuaaaugaggcaugacuguucaaaggcagguaaugucuucuguggagacagguauuuagacgaacacuucaga

SEQ ID NO: 4200864 - RNA, 76 nt, Human
ucuguagaacaguuaauagauuugauuuuaaaggcauuguuacagccuuuuauaaaguuguauugaaaccugcaga

SEQ ID NO: 4200865 - RNA, 83 nt, Human
ucuguagcuguauuucugaauguucaugucauauguuaccagcuuugauacaguucaugaaauuugaaguacagcaauacaga

SEQ ID NO: 4200866 - RNA, 82 nt, Human
ucuguaggagcaaaauggcugacuuuucaugggagugaggaagggcuucccagaagagaugccacuugagcugugccuuaga

SEQ ID NO: 4200867 - RNA, 70 nt, Human
ucuguagguggggggaaaugcuuuuuaccauaaccacggaagauacauuaugucucucugaaaccacgga

SEQ ID NO: 4200868 - RNA, 57 nt, Human
ucuguauauucucugguuguguauaauaugagcuugcgcagcugagaaauauacaga

SEQ ID NO: 4200869 - RNA, 66 nt, Human
ucuguauuuuccccaggagcaaugauucaguauuugcuaagucagcauuuguggugacuuuauaga

SEQ ID NO: 4200870 - RNA, 105 nt, Human
ucugucaaauauuagacaaagauacacuugaccuggagugaaguaucacgaauuuuuaaacauuuaacuccuaguguguauuagugugaaacuaaguugagcaga

SEQ ID NO: 4200871 - RNA, 55 nt, Human
ucugucaaaugagcaaguaacucuuagaaccugaaauacaagcuuuuuuggcagg

SEQ ID NO: 4200872 - RNA, 94 nt, Human
ucugucaccucuagccauuuguuuacacugaaguguucuucugacauuaaugcuaucaguguuuguggcaaauguuagucuuuggugguauaga

SEQ ID NO: 4200873 - RNA, 64 nt, Human
ucugucaguucucugcauugucucguccaccuuuuaugggagaucgguaaagagcaugcacaga

SEQ ID NO: 4200874 - RNA, 69 nt, Human
ucugucauaagugcugaaguauucaggaaaugggugggcaaaggaauagucuucagcacuuugaucaga

SEQ ID NO: 4200875 - RNA, 84 nt, Human
ucugucaugucacugcaaauugcaauguuuuaauucuucuugauuuaguggcaggaguuaaaauauguaauguacauagaagga

SEQ ID NO: 4200876 - RNA, 59 nt, Human
ucuguccauuuggaguuggaagauuccauugaaaucuucauggcugauaauuggauagg

SEQ ID NO: 4200877 - RNA, 89 nt, Human
ucuguccuacccaccuuggagcucuuuagagucucccuucuggguucugaaugccagugggagacagugagagcuggguagagaaaagg

SEQ ID NO: 4200878 - RNA, 89 nt, Human
ucuguccugggugcuggguguuggguacugaccgucuccugcaaaggcgauugaagggugaccagccauccuaguguacccgggacuga

SEQ ID NO: 4200879 - RNA, 57 nt, Human
ucuguccugugucuaggggucuucucaucaggagaagaaggccagacacuggaaggg

SEQ ID NO: 4200880 - RNA, 89 nt, Human
ucuguccuuccuuuugcuugccucaugcccaauuuuccaagccaaggaaagguuugggaaggcguggaagcagaaggucugggcacaga

SEQ ID NO: 4200881 - RNA, 60 nt, Human
ucugucuccucagaugacuccaaauacuaauucuauaucaggauucaaucugggaacaga

SEQ ID NO: 4200882 - RNA, 65 nt, Human
ucugucuguggagcccucauaagcagcauccugccuuagagauggguuuuacuuagaauuacaga

SEQ ID NO: 4200883 - RNA, 56 nt, Human
ucugucugugugcaugacauguguuaugaagaaaacacauugaauacagagaugga

SEQ ID NO: 4200884 - RNA, 74 nt, Human
ucugucuuagaugcagagagcugcuucaucuggaggucacauccuuuccagggcagcucucaucugaugacuga

SEQ ID NO: 4200885 - RNA, 89 nt, Human
ucugucuucaccuuugcuguuucucucccuuucuugugauccaguuggagcaucaguuuuagaggggugaaaagagcugaggaggcagg

SEQ ID NO: 4200886 - RNA, 103 nt, Human
ucugucuugaugggggagguagagagccuggugaucacuucaguggauaugucuugugacauuguggacugaucagggcuagguccucugcuagaggacauga

SEQ ID NO: 4200887 - RNA, 70 nt, Human
ucugugaaauguguaauguggaugccauaaaaccauaauacugguagccaauuuaaacauuuccuaagga

SEQ ID NO: 4200888 - RNA, 55 nt, Human
ucugugaacaucacauugacagucuuuaucgugagauguccagugaugucaagga

SEQ ID NO: 4200889 - RNA, 64 nt, Human
ucugugaaugguggccacgcguuuggauguuacagagcaagcacguucuucauuacuucacaga

SEQ ID NO: 4200890 - RNA, 58 nt, Human
ucugugacaucaggaccagauacuccauccccagcauccagaugccugaugucagagg

SEQ ID NO: 4200891 - RNA, 98 nt, Human
ucugugaccacaugcacaucauuuaagcucucauuauuauuauuucguuaucuauaaaauggggaggguaagacuuaaaugauauguauguuugaaga

SEQ ID NO: 4200892 - RNA, 57 nt, Human
ucugugacucauaucuguagauagcaauuuucuuacagguguuuguugagugauagg

SEQ ID NO: 4200893 - RNA, 74 nt, Human
ucugugagcuggcacuuuuccugggaagguccagagcuggccuucagggcaccaaaaaagaugccacuccuaga

SEQ ID NO: 4200894 - RNA, 55 nt, Human
ucugugaugaggcuuauuuuuaguuacuaacaauuuuugaagccuaaauuacaga

SEQ ID NO: 4200895 - RNA, 112 nt, Human
ucugugauguaggggggugugugugucuguguauguguacauauauauaaguauauacaugugggucuaaacauauuauacagcuauaaauauauauuguccuucuuauaga

SEQ ID NO: 4200896 - RNA, 114 nt, Human
ucugugauuugagucccuuggcucgguguuaauauugaguguuugauggcagcagaagauguucaguaagcacuucuagagcugaagauagcugugcaagucuguaguaauagg

SEQ ID NO: 4200897 - RNA, 69 nt, Human
ucugugcacaauaggcauuuuuuuucagauuccuuaguaggauaaauaggagaauguuuggaacacaga

SEQ ID NO: 4200898 - RNA, 89 nt, Human
ucugugcucugcgggagccaaagcagcuuucggcccucggggcugguggcgcccugggaagcugcuuggcucaggggaaggagcaggga

SEQ ID NO: 4200899 - RNA, 126 nt, Human
ugauuauuuuuaaaauucucuuucccuguggcugguaguaucguuuuuccaugaagugguaucagagauuaaaugguguuaucuguccaugaacaauuuacuuacuggagcaugaaaaagugauua

SEQ ID NO: 4200900 - RNA, 55 nt, Human
ugauuccacucugaggaucguauuggauuuauacuuaacucaaaugguggaauga

SEQ ID NO: 4200901 - RNA, 79 nt, Human
ugauuccaggacagcaucuaguacagucuaguccucaggaaacagggacugaaauucaacauggaugaaaccugaauca

SEQ ID NO: 4200902 - RNA, 80 nt, Human
ugauuccgguguuguuugcuucagccaaacuccucugucuccauuggaguagucagcagauaauauagguugaauaauca

SEQ ID NO: 4200903 - RNA, 100 nt, Human
ugauucgaauaucuggcguguuucacaaggaaagaaccuccugcuguauuuuuaaacguguguggaaaguuuuccaugguaaacggaaaucagagaauca

SEQ ID NO: 4200904 - RNA, 76 nt, Human
ugauucuaagagggucaccccaccugcuggccaugagugauuggucagaggugagcaugugaccaaagguggguca

SEQ ID NO: 4200905 - RNA, 61 nt, Human
ugauucuaagcacgcugaagucuuacagucaguacuguggagaaauagaagcuuagcagca

SEQ ID NO: 4200906 - RNA, 57 nt, Human
ugauucugcuuauggguggauuuauuauucuauaugaagaacccauucagugaauua

SEQ ID NO: 4200907 - RNA, 60 nt, Human
ugauucugcuugccuggacagcguuaggccuguuuccaggccugaggcaaguggugguca

SEQ ID NO: 4200908 - RNA, 64 nt, Human
ugauucuguuuacucagaaauacaacguuauuaaaauguuguucuuuugcuuagacagauagca

SEQ ID NO: 4200909 - RNA, 79 nt, Human
ugauucuuccauaauucugcauaauuuccuggcaguaauuucuuuacuucuugcuuuauuuaggagauggaaucaguca

SEQ ID NO: 4200910 - RNA, 70 nt, Human
ugauucuucccucuuucacugugauuuuaugcaaguaaaaucacacaaguagauggggaaaccagaauca

SEQ ID NO: 4200911 - RNA, 91 nt, Human
ugauugaauggcaauguugcugucuuuuuagagaguaggauuuaaaauuuugaguugcugaaaaggcuugcgugaugugcuagaaaaauua

SEQ ID NO: 4200912 - RNA, 128 nt, Human
ugauugaggguggcuucuggagcaugggucacgcagcacucuaagccugccccgggcacgggccaagcaugcugcugaggcuggaauauguugcccaucagagaguugcaggaagccacugcauguca

SEQ ID NO: 4200913 - RNA, 58 nt, Human
ugauugauggaggugauuuacccuugaucaaguucauacugagucacucuuacaguca

SEQ ID NO: 4200914 - RNA, 88 nt, Human
ugauugauuagcauguguguguguucucaauuauugaugguaauggcccguggauguaaugugaacuugccaaugcugcugauaaucg

SEQ ID NO: 4200915 - RNA, 98 nt, Human
ugauugcuucaugaauuucuucauaaaauggcuuguucuuuaauaucaaauaauaaaacguagguauuagggcccauuuaaguaauuuagaguaauua

SEQ ID NO: 4200916 - RNA, 82 nt, Human
ugauuggggcauauguguuuguauaguugcugguauuucaggccaaugacugcuuugacaaaugauaccuugcuuucaauca

SEQ ID NO: 4200917 - RNA, 57 nt, Human
ugauuguaaugugaauaagccaugucuucauagcccugggucauucacauugcuuca

SEQ ID NO: 4200918 - RNA, 56 nt, Human
ugauuuacaguagugucuaaacauugaguggcccuagauauuucuacuguggauua

SEQ ID NO: 4200919 - RNA, 75 nt, Human
ugauuuaguucuauaaguaguuguugaagacuuucuauauugaaaguuguuucuagacacuucagggagcuugca

SEQ ID NO: 4200920 - RNA, 80 nt, Human
ugauuucccuaaaagcacagggugcuagagagucccuaagaacuccucagacaccucucaagcccugugcuggggaaaca

SEQ ID NO: 4200921 - RNA, 111 nt, Human
ugauuucuuucuguggccaacuauucagcuuaauauauuaaaagccauuauuagagguuuuugaaaguccuucuugaguuacaaauaguuggaugaaugcuuuagaaauca

SEQ ID NO: 4200922 - RNA, 72 nt, Human
ugauuugaucucauucagcaauguucuuugaaauacagucagaaugcuccagagcugaaagagaucaucuca

SEQ ID NO: 4200923 - RNA, 63 nt, Human
ugauuugcauggagaauaacagaauugaaguagcuugagucuguuacuuugucuuugcaauca

SEQ ID NO: 4200924 - RNA, 70 nt, Human
ugauuugggaguauugcuugagcccaggaguuugagacaagcuugggcaacacagcaagaccccaccuca

SEQ ID NO: 4200925 - RNA, 88 nt, Human
ugauuugguagucucaguaauuaaugcuuuugugauuacguuaaguauuugugacuaaacgcaugaauagcucaacugaccaaaauca

SEQ ID NO: 4200926 - RNA, 89 nt, Human
ugauuugguauauuuacagaauuaucaggaaauguuauaggaguuguauugcuuugugacagcucuuguauuucugacauaccaacuca

SEQ ID NO: 4200927 - RNA, 58 nt, Human
ugauuuguuuagugccaaguuuccagaagacaacaaagugugguacuaaaugaaauca

SEQ ID NO: 4200928 - RNA, 66 nt, Human
ugauuuuagaagccagaguuuuugagaacuuuuugggaagauucuacaaacucugguaaaaaauca

SEQ ID NO: 4200929 - RNA, 59 nt, Human
ugauuuucaugggugaucuuugauuucuuauaaucacaauggauuguccugaugaauca

SEQ ID NO: 4200930 - RNA, 81 nt, Human
ugauuuucauuuuucuugucugugaaauggaaauaguaaugaaaauacuaaucucugcuuuaugauguauugugagaauua

SEQ ID NO: 4200931 - RNA, 100 nt, Human
ugauuuuuuuuagauauucaccccauuuccacauuguguuaugggaaucugaacucacacacaucuccagaagugggcugaauuggucuaaggauaauca

SEQ ID NO: 4200932 - RNA, 56 nt, Human
ugccauugugggaggacuccugcuccaauacacagcagucucucccagaaugagca

SEQ ID NO: 4200933 - RNA, 66 nt, Human
ugcccaagagcuagaaauugguuagaaacugguugagccaggauuugcaccuaagucuaucuggca

SEQ ID NO: 4200934 - RNA, 62 nt, Human
ugcccaagccaggcuguuuuuauuacuguggcuuuacaauauguuuugauagcuggugggca

SEQ ID NO: 4200935 - RNA, 82 nt, Human
ugcccacaguacguuuuaaacacggagccagcauuuuuaaaguuuagauuucuggcuccuguuuaaccagcugcugugagua

SEQ ID NO: 4200936 - RNA, 55 nt, Human
ugcccagauggaggcccugaccccaaaggucaaaggcuaauuaaccaccugguca

SEQ ID NO: 4200937 - RNA, 55 nt, Human
ugcccagccuaaacuuggcaagauaauaaaucaccuuuuuaagugucguugggca

SEQ ID NO: 4200938 - RNA, 75 nt, Human
ugcccaggagcugcgggucauccccuguacucaccgguuucacaggaagugcguggaccccuggcugcugcagca

SEQ ID NO: 4200939 - RNA, 57 nt, Human
ugcccaggcuucacccucagagaaucaggcgcaauuggucugggguguggccuggca

SEQ ID NO: 4200940 - RNA, 69 nt, Human
ugcccaggggcugcugguauuuccaguuuggcugcacgaagucaacuggcuuuucagauggcccaggca

SEQ ID NO: 4200941 - RNA, 82 nt, Human
ugcccagugucuccuuguggaucucaaggaugugcuuccacauagcagcauguucuucagauggacaaggagacacugggua

SEQ ID NO: 4200942 - RNA, 56 nt, Human
ugccccagacauaacagcagagaggugaucaguggccucggugggauguuggggca

SEQ ID NO: 4200943 - RNA, 75 nt, Human
ugccccaggugucuguggccagcccuaauggaagacccacagagggcuggauguacaggucuaacacguggagca

SEQ ID NO: 4200944 - RNA, 67 nt, Human
ugcccccgcuucucuacucccagccagugucagugacaaggcacugccugggagggaggcggcugca

SEQ ID NO: 4200945 - RNA, 55 nt, Human
ugccccugaccucaggcgaaggaggggguucucauccuuuccugagcucagggca

SEQ ID NO: 4200946 - RNA, 66 nt, Human
ugccccugccagcucaaagcgcagcuaggcgcuaagccucuguugcagcgagcugguuccucugca

SEQ ID NO: 4200947 - RNA, 86 nt, Human
ugcccguuuccucuguaacauguaggagagucacaaugcccacaccacguggauguguuaggaacccuaguagcagagcacgggua

SEQ ID NO: 4200948 - RNA, 64 nt, Human
ugcccucugcaggccgccaugggaagugcacacugcauccccuaggcaggauuguaggcgggua

SEQ ID NO: 4200949 - RNA, 56 nt, Human
ugcccugcagcccuucaaaggcugagcgcugugcugugcgggaaaggcugcuggua

SEQ ID NO: 4200950 - RNA, 116 nt, Human
ugcccugccccaccuuugaguguccuguggagaggacuggaggucacuuccugaagcuugucagaaaggcgccuuccuucuccucgcaggagucucuaaaggauguuuaagggaca

SEQ ID NO: 4200951 - RNA, 80 nt, Human
ugcccugugaagaguuaugagaagguggaggagcagugaagggaauccuacuuugaccaccaucugauuaaucuagggua

SEQ ID NO: 4200952 - RNA, 87 nt, Human
ugccgucauaaugucuuagugcagugcauuacucacauguuuaugcugcugguguaaacagacugcacugccagucauaugaaagua

SEQ ID NO: 4200953 - RNA, 66 nt, Human
ugccgugccgggcuggcugcucugauacccgucaaugggcucauucagccagggcccgguuuugca

SEQ ID NO: 4200954 - RNA, 129 nt, Human
ugccguucuuucaaaaucaucuucaaugagguugccuucuuggccugugcuucccuuuauucaucugggggcacuggaggccaaggagcugcguggagucuucaccugauggaacugauggaaguggca

SEQ ID NO: 4200955 - RNA, 104 nt, Human
ugccuaaagugacaacaucuccuguuucuuuuaucuggccuggugcccuuuuggaaugccacagguacuaugggagagagggagaaggucuguuuucuuaggca

SEQ ID NO: 4200956 - RNA, 98 nt, Human
ugccuaaaucagcuuccugcuguguuccucaguuucaugcugcccacuguuagggccauguucugcagagaagcaguagaaggaaguuguuaagggca

SEQ ID NO: 4200957 - RNA, 66 nt, Human
ugccuaauauacacauaugcauauaugugcauauauuuaucagguauguauguguguauauuuaca

SEQ ID NO: 4200958 - RNA, 88 nt, Human
ugccuagcggguccuugggucagugagugaggugccgcgcguaaaccccgcacucuccucccugcccacagggaucgcccguugugca

SEQ ID NO: 4200959 - RNA, 57 nt, Human
ugccuaugccuaccuccagaaaauguugauucauuggucuggaguagagcacaggca

SEQ ID NO: 4200960 - RNA, 71 nt, Human
ugccucaaagcgugauguucugagcugaaaauuacauauaguguaaagauccuuagcaacaucaaagggca

SEQ ID NO: 4200961 - RNA, 58 nt, Human
ugccucagagugggcuugcuaucccugaggccaggcgaggcgagcugggcucugugca

SEQ ID NO: 4200962 - RNA, 80 nt, Human
ugccucaguuaucccaaaugcaaaauggagauaauaauuguaccucucucacaggguuguucugaggauucaaugaggca

SEQ ID NO: 4200963 - RNA, 83 nt, Human
ugccucauucaaaaguucucacccagacauguaucccugugagguguugucugcauguguguggcugacaauuuuuugaguca

SEQ ID NO: 4200964 - RNA, 99 nt, Human
ugccuccucagaaugaccugggccaggcuugggaaugccagcgcuuuuagcaguugauugaucugcauuugguuuggcucaggccaacugagaggggca

SEQ ID NO: 4200965 - RNA, 84 nt, Human
ugccucgcgaggugugccucugcaccaguacugugcccggccuggccuacggcaucugcgcggcgcagaggauccagcaaggca

SEQ ID NO: 4200966 - RNA, 77 nt, Human
ugccucuaugaguuuucuaugccacaccugguggcugccugccucaccagugggaaguggaaaaugaaaucuuggca

SEQ ID NO: 4200967 - RNA, 81 nt, Human
ugccucuccucacccucccucucuuccugcagggccugggaagggcuuugagggagccugggagccaugugaagaggggca

SEQ ID NO: 4200968 - RNA, 67 nt, Human
ugccucugaguuuggagaagagccuucagcccugaggauuagccugcugcuuuucuccuucaagcca

SEQ ID NO: 4200969 - RNA, 76 nt, Human
ugccugagcaugcuccucuuuuccaucuguguuguuuuuuaccccagcauacuguuggaaggguugcucgaaggca

SEQ ID NO: 4200970 - RNA, 56 nt, Human
ugccugauaguaauagugauugugaaagaaucacuaauucaguauuaccucaggca

SEQ ID NO: 4200971 - RNA, 72 nt, Human
ugccugcaaaagcucugggaaugcuuaucugugcuggcagauaacugcucccagguuuaaacuucaaaggca

SEQ ID NO: 4200972 - RNA, 90 nt, Human
ugccugcaucacugguggcccucaguguucuccuagguugauugcauuaccuuccuagguggacauuuggccacuaguuccuaucaguca

SEQ ID NO: 4200973 - RNA, 78 nt, Human
ugccugcccucagggagcucacaguccaguagaaaguucucugaggaugggaugggcucucugguacuggguggugca

SEQ ID NO: 4200974 - RNA, 59 nt, Human
ugccugccugccugccuccccaagagcauaaacgucugggucucuaguacaggcaggca

SEQ ID NO: 4200975 - RNA, 57 nt, Human
ugccugcuuguguaccuggugaugguauuguacuucagaaaacaggugagggaggua

SEQ ID NO: 4200976 - RNA, 65 nt, Human
ugccuggcaccccagucugcacagccccgcacgcccugggggaguguaggauggggguggaggca

SEQ ID NO: 4200977 - RNA, 67 nt, Human
ugccuggcucccccaucauagcugucaucccucuguggauaucaggcccaugagggcagccacagca

SEQ ID NO: 4200978 - RNA, 56 nt, Human
ugccuggggcuggucaccggggcuuacagcaaggaacuggaagccuuuccagagca

SEQ ID NO: 4200979 - RNA, 64 nt, Human
ugccugggugcccucugcuccuccgggaacuucuccgagcccgcaggccggugcgcaccaggua

SEQ ID NO: 4200980 - RNA, 66 nt, Human
ugccuguauuuguccucuauuuauuaaauagauuuuuugguagaaagaaggaacaaaguagaggua

SEQ ID NO: 4200981 - RNA, 103 nt, Human
ugccugucuuguaaaugaagaaauggagauuguagucauaaucucuggaguagaaagagaacauucaagauaaucuagucauuguuucuuuacgaucaaggua

SEQ ID NO: 4200982 - RNA, 61 nt, Human
ugccugugacccaaggaugcgauaacuaccaaaauuuugcuggggcuguugggaacaggua

SEQ ID NO: 4200983 - RNA, 56 nt, Human
ugccugugcccuucuuggcauucagaaauuccucugugccacaggaaguaugggca

SEQ ID NO: 4200984 - RNA, 77 nt, Human
ugccugugguacauuaauaccucugauuucacuccaucacuacagauuuauuguauugguguacuuauagcagagua

SEQ ID NO: 4200985 - RNA, 113 nt, Human
ugccuguucccaccgccucauggccuggagaagucuauuucagucuuacuagucuguuagaagcaacaguaauuaaaauggaucugcaggcuucuggggucuuuggauaggua

SEQ ID NO: 4200986 - RNA, 71 nt, Human
ucuuggcuuugguaguucuuucucaauguucaaggccgccuugagauuuggagguaauucccucgucaaga

SEQ ID NO: 4200987 - RNA, 129 nt, Human
ucuugggaaggaugaaaugcugcaguuuucauugaacuggaaccuuuuauucagucuggauacccgggcugccguaagucaggauuaccgcuuguuuacuacugcuuucucaguuucgcuuucccagga

SEQ ID NO: 4200988 - RNA, 74 nt, Human
ucuugggcaauaaaauguaaugauugggauuauauuuuucccaauaaaauucauuuucauugcuauggacaaga

SEQ ID NO: 4200989 - RNA, 68 nt, Human
ucuugggcugaguggcagccagagucaagcccucugcagacucugcagagcuauucagcuuauacaga

SEQ ID NO: 4200990 - RNA, 61 nt, Human
ucuugggucaugaucacagcuagugcuaaaccacuccaugcugccugaucauacaccaggg

SEQ ID NO: 4200991 - RNA, 76 nt, Human
ucuuggucuuccuugagucauggauuggcaagaaaacauucauucuuaauaaaggcucagggaaccagauccagga

SEQ ID NO: 4200992 - RNA, 84 nt, Human
ucuugguguucgcucucaaaugggcucuuuucaguaucacauaucauaugcaggaugcagaggggcccggcuuacauaccgaga

SEQ ID NO: 4200993 - RNA, 55 nt, Human
ucuugguguuugucuacaggccgccccugcugcaugaaaaagacagacaguggga

SEQ ID NO: 4200994 - RNA, 98 nt, Human
ucuugguugcuuccaaguuuuugcaguuaaaaauaaaccuucauauucagauuguugcgugaauguaaguuuucagcucauuuggguaaguaccaaga

SEQ ID NO: 4200995 - RNA, 84 nt, Human
ucuuguaaauucucauuuguuuaaaagaaaucauagaaaacacaugucuucuggagaugacuuuuagaaauggaguuguuaaga

SEQ ID NO: 4200996 - RNA, 76 nt, Human
ucuuguaaggaugucagucauuuuggauagggcccucucuaauggccucauuuaacuuugauuaccuccucaaaga

SEQ ID NO: 4200997 - RNA, 95 nt, Human
ucuuguagaauuagaagcgcaggugaccagaagucggcgguguuaaagaagccacaucacuucucuggcuaucuguuucuaugucuuacacuaga

SEQ ID NO: 4200998 - RNA, 77 nt, Human
ucuugucaaaauguaaucuuauugcagaauuucuuacgcucucuagaaugauguaacugguuauaauuuuugacuga

SEQ ID NO: 4200999 - RNA, 93 nt, Human
ucuuguccuggaagauggguucgugauggaagaugauuaauagcagcuugacuuuguuaaacaguuacaugugcugggcacccuaggacaaga

SEQ ID NO: 4201000 - RNA, 84 nt, Human
ucuugucucacauccuucauacucagcucugcccagugcagcucagucacaaagaagcugugguaugaaaugugaagaucugga

SEQ ID NO: 4201001 - RNA, 85 nt, Human
ucuugucugucuuuguuugcuuuucuauaagaacuuucaaguaagcuugucuaguuccuaagagaauugucagggauacucaaga

SEQ ID NO: 4201002 - RNA, 56 nt, Human
ucuugucuuagagugaaaacuuuaaaaguuuaaaggaaucaguuuuagagauaaga

SEQ ID NO: 4201003 - RNA, 79 nt, Human
ucuugucuuagaugcugggaccacagaguguuguggcugacuguuuauuugacacucuccuccaguggauaggccauga

SEQ ID NO: 4201004 - RNA, 111 nt, Human
ucuugugaggggaguggcagggguucauucagaggaaugagaaucuuugaccgaagagguaauagugaagauaccucaauucuuugaaauuauugucccuuuuuuuaauga

SEQ ID NO: 4201005 - RNA, 57 nt, Human
ucuugugcaaacacaggcagugggccaguuuggccugcaggcuguaguuugauaaga

SEQ ID NO: 4201006 - RNA, 57 nt, Human
ugaaaagagcuggcagcuggauccuucuagcacagacucagcugccuuuucuuugca

SEQ ID NO: 4201007 - RNA, 77 nt, Human
ugaaaaggacacagaccuuucuguucuacagcucuggucuggaacaggaauauguuugaaauuauauguaauuuuca

SEQ ID NO: 4201008 - RNA, 71 nt, Human
ugaaaaucaccagcauaccuuuucacaguguacaugcucuguccgagguccagugcucuuggugguuauua

SEQ ID NO: 4201009 - RNA, 69 nt, Human
ugaaaaucauagccaugaacauuuguaugcuuacaaagcugccaaaugaugcauggcuagugagucuca

SEQ ID NO: 4201010 - RNA, 89 nt, Human
ugaaaaugcugaauagacuugguuaguaaauuugaugagugaaauuuuauuaugaaaauaccugccaaguguucugucaugcauuucca

SEQ ID NO: 4201011 - RNA, 80 nt, Human
ugaaacagugggcuccugaaauuccauuaucugcagagacugcccagcaguuaggagaagagucagggccuaaugucuca

SEQ ID NO: 4201012 - RNA, 64 nt, Human
ugaaacuguggaaaauccccagcaaccuuaaaugagauaggugcaggugauuaauccaguuuca

SEQ ID NO: 4201013 - RNA, 70 nt, Human
ugaaagaaaaugaaugaaugaaugaaugaggacacuuuuguucuucuggguaauucuucuucaucuuuca

SEQ ID NO: 4201014 - RNA, 58 nt, Human
ugaaagcacugauucucaacucaaaugugccugcacaugggaauggccaguauuuuca

SEQ ID NO: 4201015 - RNA, 55 nt, Human
ugaaagcagauagcucuguuguugcauauuugacuuaauagagcuacugcuuuua

SEQ ID NO: 4201016 - RNA, 55 nt, Human
ugaaagcagcaccaauaccauugcggccgccugagugccugagugcuugccuuca

SEQ ID NO: 4201017 - RNA, 56 nt, Human
ugaaagcagugccaugauuaugaguccgggcugcauagucgggccaccuguguuca

SEQ ID NO: 4201018 - RNA, 59 nt, Human
ugaaagcuccuggaagcuugguaaagaugagaaacaaacaugagcuccuggggucuuua

SEQ ID NO: 4201019 - RNA, 114 nt, Human
ugaaaggcaauuuauuuaagucuggaaguuuagguugaagauaagaauuuugaaacuguucuuacuuuaucuccuagauuccaguguuacuuuuaagaaaucagaugucuuuca

SEQ ID NO: 4201020 - RNA, 64 nt, Human
ugaaagggacauagacuguacaucuggagcacaaaggcagguuuaaccagcuuuguccugcucg

SEQ ID NO: 4201021 - RNA, 66 nt, Human
ugaaaguagugcuuaccaaguguuucaugagaggcgaugauuauuaaauacaugagcacacuuuca

SEQ ID NO: 4201022 - RNA, 72 nt, Human
ugaaaguggugggcgaacucaucaauuagaaggaaguuaguguaaaauuuauggucuugccucccaccguug

SEQ ID NO: 4201023 - RNA, 65 nt, Human
ugaaaguucaauaccaauuugggccucagggucacugaguuacaaauaggaguggaaccuuuuca

SEQ ID NO: 4201024 - RNA, 65 nt, Human
ugaaaguucugggggagaagaacgaauugagaggauuauacguuggcugcuccccaaggcuagca

SEQ ID NO: 4201025 - RNA, 57 nt, Human
ugaaaguugcacauaagagaauaaucaucuaaaagauauucuuauuguguacuuuua

SEQ ID NO: 4201026 - RNA, 115 nt, Human
ugaaauaauuucuuauguuaaauagcuucuaacauuuauggccacuggacugauucuuagcacauuaauucuuccugucaugagguuuggggauacaucagaacaauuuauuuca

SEQ ID NO: 4201027 - RNA, 85 nt, Human
ugaaauacaguguguguucuuugauguguguagagaaagaauuguguucaggcaaguuuaaagaacccaugaauuguaaaaauca

SEQ ID NO: 4201028 - RNA, 58 nt, Human
ugaaaucugaguuuauguucccccaacaaauuggaggacacauuuauuucagaauuca

SEQ ID NO: 4201029 - RNA, 130 nt, Human
ugaaaugaaggugauaaguuagaagaccauugcaaaucccaacuuucuuucaaggcuugggcaaggaugauuuugcuggagguggugagaaaagguugauuugggagacauuugggauuaaagccuggag

SEQ ID NO: 4201030 - RNA, 68 nt, Human
ugaaaugaaugugauucgauaguuaucgcauccucauaaauguguuagauugaaucccauucauuuua

SEQ ID NO: 4201031 - RNA, 78 nt, Human
ugaaaugaguggcaguuugggagcuacaggacagcaaaaugcauucaguucaugucaguuuguaaauuacucacuuua

SEQ ID NO: 4201032 - RNA, 70 nt, Human
ugaaaugcaaaagagugagugguaaucuuuaaaagauuaaagagcccuuccaugacucuucuacauuuua

SEQ ID NO: 4201033 - RNA, 72 nt, Human
ugaaaugcauacuggacaagaaugacuguugguagcaaccacugaaacaauuuuuguugucuaagcuguuca

SEQ ID NO: 4201034 - RNA, 70 nt, Human
ugaaaugcugucuugaccuuucucucuccauugguauugcagauauucagagggaaggacagauguuuca

SEQ ID NO: 4201035 - RNA, 69 nt, Human
ugaaauggaaccucuggggcccuacaguuguucauuuccuggggggugacaaguagagguugcacuuca

SEQ ID NO: 4201036 - RNA, 63 nt, Human
ugaaaugguccauccuaaagaaguuggacagucuuaguucauuucccacuggacuauaauuca

SEQ ID NO: 4201037 - RNA, 85 nt, Human
ugaaauguggacuugaaauaucauuuucaucucccucuauauauagagggcagaugucaugauuguuucugaauccauucccuca

SEQ ID NO: 4201038 - RNA, 81 nt, Human
ugaaauuaaggaauuuggaggccucuccugcuuguccuuccuccaggguaucugcaugauccucuuuagauucuuaguuca

SEQ ID NO: 4201039 - RNA, 73 nt, Human
ugaaauuauucugugaaacagcucuggcaugcaauccagacccuuugcagccugcuguguuuucagaauuuca

SEQ ID NO: 4201040 - RNA, 58 nt, Human
uggcuccuuccgcagcaugccugcucacccccagaacccgcagcugugggaagagcca

SEQ ID NO: 4201041 - RNA, 99 nt, Human
uggcucuaaaucaacugggcacaguggcucacgccuguaaucccagaacuuugggaggcagaggcaggugggucacuugaguccacgaguuugagacca

SEQ ID NO: 4201042 - RNA, 81 nt, Human
uggcucuccuagugggucagacagccagugggcccuggcucuuucccaguuggcccgcugaucugaccccucuguugaaca

SEQ ID NO: 4201043 - RNA, 85 nt, Human
uggcucucucagcuguguuucaggcuuggugcuccagugcccuccucaaggccauaguggaggcagcagcugggugagagggcca

SEQ ID NO: 4201044 - RNA, 63 nt, Human
uggcucugaggcugugaggugcugcuuccaccuggaaaaacuggcccugagggcucggagcca

SEQ ID NO: 4201045 - RNA, 65 nt, Human
uggcucuggugacacacccuuccuugcguugugaguguguaaggcagguaugguaccaggcgccg

SEQ ID NO: 4201046 - RNA, 55 nt, Human
uggcucugucaaacugcacacaucccagccaaaggguagucaggggagggagcca

SEQ ID NO: 4201047 - RNA, 70 nt, Human
uggcugaaacauucugcaucucguacuuugauaaauuuaccuguauaucaggcagaauguucucugguca

SEQ ID NO: 4201048 - RNA, 57 nt, Human
uggcugaauaaaauaugguguugcuacaccucuacaccacagaauauuaugcagcca

SEQ ID NO: 4201049 - RNA, 65 nt, Human
uggcugagggcacuaugaagccaggaaagcaagaaccagaagauccucgugcuuccccugagcca

SEQ ID NO: 4201050 - RNA, 63 nt, Human
uggcugcacauucaugacccacugguguugguaggcauuucuggauuuuggaugcugcauaca

SEQ ID NO: 4201051 - RNA, 66 nt, Human
uggcugcccucucaggugaggcacaugugguggaaaaccaacuacaaccagcacuggagggcacca

SEQ ID NO: 4201052 - RNA, 78 nt, Human
uggcugccugccucugauucacaagacuccucagaauauuuauaugagcaugggcuuucucagaguucucaggagcca

SEQ ID NO: 4201053 - RNA, 77 nt, Human
uggcugcuaggaagcucaaagccaugauguaaguuuaagcacaguuacugucuugguuuagcuuucugggacaguua

SEQ ID NO: 4201054 - RNA, 88 nt, Human
uggcuggcaccauuagguagacugggauuuguuguugagcgcaguaagacaacaacaaaaucacuagucuuccagauggggccagccg

SEQ ID NO: 4201055 - RNA, 57 nt, Human
uggcuggcgccgggcuagccacaccuguuugccaucagggcugucucggcccagcca

SEQ ID NO: 4201056 - RNA, 61 nt, Human
uggcugggaaacagaaggauaucacugugaauuuugacaaucguccaguguuuuccaguca

SEQ ID NO: 4201057 - RNA, 61 nt, Human
uggcuggucaaacggaaccaaguccgucuuccugagagguuugguccccuucaaccagcua

SEQ ID NO: 4201058 - RNA, 69 nt, Human
uggcuggugaguucagagaacccaaagugggacagaugggccaugcugggguucuuggacuuaccacca

SEQ ID NO: 4201059 - RNA, 59 nt, Human
uggcuggugccuacuguacugacaaagcagauccaggcugucagucuaggaaugagcua

SEQ ID NO: 4201060 - RNA, 71 nt, Human
uggcuguagggaggaaggguuggaaaaaagagaagauguuuucuaucuuggaccuuuaccuaaaauaggca

SEQ ID NO: 4201061 - RNA, 62 nt, Human
uggcugucagaaggugaaggguaaggagagacucaaauugcucucagucuucuggcuugcua

SEQ ID NO: 4201062 - RNA, 72 nt, Human
uggcugugcccagcuccagcucuggaagagucucucugaggagcagggccuggagcugggccugcaaagcca

SEQ ID NO: 4201063 - RNA, 59 nt, Human
uggcugugguuuaucccaguuccugggcuggaaaggugcagugguuggggauccagcca

SEQ ID NO: 4201064 - RNA, 101 nt, Human
uggcuguguugugugucuuguuugauguaaagauaguuucuguaauaguuuugcaguuugauuguucaucuuuaggucuucaauuacaaccugcacaucca

SEQ ID NO: 4201065 - RNA, 56 nt, Human
uggcuguuacucuuuucauuucuggagcauaauagaaguagaagggagaaggguua

SEQ ID NO: 4201066 - RNA, 77 nt, Human
uggcuguuccuggggcuuagcaauggaguuggcuacucgcuuauuacauuucaguugguggguccccaggcuagcca

SEQ ID NO: 4201067 - RNA, 70 nt, Human
uggcuguuucaugcugugucuacaacuuaaggccauuucuuccagguaguagaugcaauauguacagcca

SEQ ID NO: 4201068 - RNA, 74 nt, Human
uggcuuaaaaguccacaaaauuacuaucuuacagcucuguagggcagaaguucaaugugguucuuacuaggcua

SEQ ID NO: 4201069 - RNA, 129 nt, Human
uggcuuagaagauggagaaaggggaaaauaagccaagggcuguaggagcuggaaugggcauaaaaauagauuguuugcuagagccugcagaaggaacuuggcccugcugacaaccuugauuuuaggcca

SEQ ID NO: 4201070 - RNA, 79 nt, Human
uggcuuagcaaggaccuuccugggagguaaaccagcauccccuguggggagcuuaucuacucagagucaccgcugucca

SEQ ID NO: 4201071 - RNA, 84 nt, Human
uggcuuauagaugcugggacguacuuguucauuaguucaaaccacguuaaaagugagcaguuuguuccagaaucaaguauguca

SEQ ID NO: 4201072 - RNA, 63 nt, Human
uggcuucauguaguuugaguugaugugucauuugacaccaaaauaaucuugacuacugaauca

SEQ ID NO: 4201073 - RNA, 66 nt, Human
uggcuucgcuccgguggugcgcccagcccacgccuccgggcugcagcugcgggaccggagcggcca

SEQ ID NO: 4201074 - RNA, 56 nt, Human
uggcuucuaaaaugacauccagcuugguucuccaacaugugugcaaauggaagcca

SEQ ID NO: 4201075 - RNA, 56 nt, Human
uggcuucugcuuucaguggaggcauugagaagcugacaagcugagugcagauguua

SEQ ID NO: 4201076 - RNA, 80 nt, Human
uggcuugccuuuggguccugugugcuuucuuuagguucuaauuagaagccuggaguugguacaauggggcaggcaaggca

SEQ ID NO: 4201077 - RNA, 59 nt, Human
uggcuugcucugcugauaggauuccaugcuugccuggugcccuuucagaacagaagcca

SEQ ID NO: 4201078 - RNA, 66 nt, Human
uggcuugggggcuacccuaacauugccuguaugaaaugcaggcuuugacuuggggcagccaggcca

SEQ ID NO: 4201079 - RNA, 81 nt, Human
uggcuuucagcuauuucuguaguauaguuuauuuucagugccuuucucauuaaaaaaguauuacauuuaguaauuaggcca

SEQ ID NO: 4201080 - RNA, 58 nt, Human
uggcuuucucuaggagcuuuccaagauuuguuuugcaaagcugccaaggagaauacua

SEQ ID NO: 4201081 - RNA, 78 nt, Human
uggcuuucuuuaguuaguagauaauggcaacugaauaaauuaauugcuuucccugccucuugcugcuacugaagacca

SEQ ID NO: 4201082 - RNA, 130 nt, Human
uggcuuuugcuuguuucuugaauauaauccugaaggcagaaucuaaguuuuguaacugaugauuuaugaacauuauuuuugucuagaagaggugauauuccuaccuacuuugaaaucagcuuggagugca

SEQ ID NO: 4201083 - RNA, 60 nt, Human
uggacucuggaauuguacugcuggguuagaaucccagcucucgcacuuacuagcuguuca

SEQ ID NO: 4201084 - RNA, 83 nt, Human
uggacuuucuacaagguugucuuauggcauguccacuggcuuccccuggaaguaagugauccaagagagaacaagagaaucca

SEQ ID NO: 4201085 - RNA, 72 nt, Human
uggagaaaaaggaggcagcaaauguggagcuuccuugaucugucucucuugauugcuugccugccuuuccca

SEQ ID NO: 4201086 - RNA, 76 nt, Human
uggagaagaguuuaugauauaacauguuuagugauaaaagcaggacaaaaaacuguucguauuauagaauacucca

SEQ ID NO: 4201087 - RNA, 57 nt, Human
uggagaagauuggucaccauucuggugagaagguggaagaugaacccaaauucuuca

SEQ ID NO: 4201088 - RNA, 58 nt, Human
uggagaagcagcuucuugaugaagccccauccuguggguuccaucaaagaaauuucca

SEQ ID NO: 4201089 - RNA, 70 nt, Human
uggagaagcaguuacaguuuugaagcagggcuuuauuugauccugucucaaagcaguauuggauucuuua

SEQ ID NO: 4201090 - RNA, 72 nt, Human
uggagaagcuuaggaggaugaugaacaucauaccaguggugguguucagugucaaaccucuuaauggugcca

SEQ ID NO: 4201091 - RNA, 76 nt, Human
uggagaauaauuauuucuuaauuuguuaccccuccagaguaacuuaagggcuugcagaaaugagaaauauuuucca

SEQ ID NO: 4201092 - RNA, 69 nt, Human
uggagaaugcuguuuacugagaacacuucacaaaagucaucauuguuuucucugagaagcaguucucua

SEQ ID NO: 4201093 - RNA, 94 nt, Human
uggagacacuugcguuugaacuguccaggcugccgacaagaugcuguuuucuccuauaucucacgaaggcuguggcauuaaacguuugucucca

SEQ ID NO: 4201094 - RNA, 83 nt, Human
uggagacagaccacuuggauaagaaacagucaagagacuuuaucaucuguuucucccauguccaagugaguauucuguaucca

SEQ ID NO: 4201095 - RNA, 63 nt, Human
uggagacaggucacauauccucgguuuggaaguggugccauuugcaguauguauuuguaucca

SEQ ID NO: 4201096 - RNA, 69 nt, Human
uggagacuuggcuucugucccugcuacauugacuuuuugucagcaggcagguagcaagcagugucuccg

SEQ ID NO: 4201097 - RNA, 111 nt, Human
uggagacuugugacucuugugguugaguagugcugcaaggauggagaggcagacaccugcccugcagacccugcaguguccugaauagccaagcaaggaagcaggucuuca

SEQ ID NO: 4201098 - RNA, 68 nt, Human
uggagagaagaggccaagccagacugugcaguccugacugcaugauccuaguggggccuuucucuuca

SEQ ID NO: 4201099 - RNA, 118 nt, Human
uggagagcaaauagcaaguuauucuggcagugaaauagggcaauggacuacaaaagguauaacuucaaauguaucuuuuccaacugcuuuugucuuuguuuuguuuuguguaccuuca

SEQ ID NO: 4201100 - RNA, 60 nt, Human
uggagagcaauguugcuguuguuguuuaauuuguuauaauacagcaacggagguuuucua

SEQ ID NO: 4201101 - RNA, 67 nt, Human
uggagagcagggcuggaguucagacaaccaccugaguguuauuccuguuacucagcccuguucucca

SEQ ID NO: 4201102 - RNA, 72 nt, Human
uggagagcuuuaauguguaaucuuagaugggucuguaacaccccagagccaauacacugaagaucuaaucca

SEQ ID NO: 4201103 - RNA, 69 nt, Human
uggagaggaagaggaggagccugaaaauccagacacaggcuugagaguuccuccucuuuccacuggcca

SEQ ID NO: 4201104 - RNA, 75 nt, Human
uggagaggcaggaaggguucuuugugaaagaugcuaacugcauuucuucagagagagcuuuccccaucugcucua

SEQ ID NO: 4201105 - RNA, 76 nt, Human
uggagagggcaaagucagggaagaguggcuggcauauugcuagagagucccuuccgauuuaccucugcuuucucca

SEQ ID NO: 4201106 - RNA, 61 nt, Human
uggagagucaguuaugucaagugcuggauagcaauaagcaucauuuuuauuugacucuuua

SEQ ID NO: 4201107 - RNA, 73 nt, Human
uggagaguuguucaacgugugugaaagaaaacguucuggagaccgguuucacacaacgugaauauacuuaaca

SEQ ID NO: 4201108 - RNA, 129 nt, Human
uggagauaaggccuuaauuaagaagugucguacugauaggggaagucucagaaugcaguggcuagcuucugcagagaauuguggggcuucuccagugaccccacagaagaguuaccugccacgucucca

SEQ ID NO: 4201109 - RNA, 68 nt, Human
uggagaugacccagaggagugacaagaacauaaacuugggaaucaaacagaucuggguuuaaauccca

SEQ ID NO: 4201110 - RNA, 55 nt, Human
uggagaugaggacauggacgucuuugagaaaggccuuauuccuccuacaucucca

SEQ ID NO: 4201111 - RNA, 58 nt, Human
uggagaugcacgagcagguggagcagcugaagcagagcauccaccgcgugcaccucua

SEQ ID NO: 4201112 - RNA, 82 nt, Human
uggagauggauacucaacuuugaugguagggauaaacuauaugcucccuccauaacagaggugagcaauccauugcauucca

SEQ ID NO: 4201113 - RNA, 69 nt, Human
uggagauggccaguguugagaucaggcauguaggauuucucccagcuucucagcccacugccauguuca

SEQ ID NO: 4201114 - RNA, 108 nt, Human
uggagauucucagaggcauucccagcagcuccaucauggcagcagcagugaccauuggggucaucuugaaaccagauggacuguuugcagucucagugagaguucuca

SEQ ID NO: 4201115 - RNA, 86 nt, Human
uggagcaaugguucucaaagugugcucccuggagcagcagcagcaccagcaucuccugggaacgcuuuagacaugcacauccucca

SEQ ID NO: 4201116 - RNA, 55 nt, Human
uggagcagggcagguaaggaucagacugcauuuggcucauggcugugcugcacua

SEQ ID NO: 4201117 - RNA, 114 nt, Human
uggagcagggccugugugagagggagauggugggaggccagguggcagccuucauucauuucuucacuuugccucuggccaucccccauuaagcuagaacagaguccugcucca

SEQ ID NO: 4201118 - RNA, 63 nt, Human
uggagccaagcaauauacccaacccauguauugugaaccauggggaaagguagcauggcugca

SEQ ID NO: 4201119 - RNA, 57 nt, Human
uggagccaggcuggcccugccacucaugcacuguguggccuugggcaaauuguuuca

SEQ ID NO: 4201120 - RNA, 55 nt, Human
ugggugguugcugaggcuccuucgcucuggccuggagagaccucaugaccaguca

SEQ ID NO: 4201121 - RNA, 57 nt, Human
ugggugucacaucuuauccuuggguaucaguuugcuccuggacuggugugagauuca

SEQ ID NO: 4201122 - RNA, 106 nt, Human
ugggugucagguagaguuuggaugaggcaggauuaagcuaucacccccccugcuguguguuaauuuauugccucagacauuuucauaucugauucauuuucaccca

SEQ ID NO: 4201123 - RNA, 73 nt, Human
ugggugugguccacuuccugcagguaaggagcuuccacaagggcagcucugaaucaucgggaguaaucgccca

SEQ ID NO: 4201124 - RNA, 61 nt, Human
uggguuagaaagcaaucuaccucuuccccuaaaccagaguguggagagugauuuugaugca

SEQ ID NO: 4201125 - RNA, 56 nt, Human
uggguuagcacagugagguauacauggaucaagaugccacugugcacacuaaccca

SEQ ID NO: 4201126 - RNA, 62 nt, Human
uggguuagcgguugauauuuugauuugguuacuguggucauauugugacagcugcuagcuca

SEQ ID NO: 4201127 - RNA, 55 nt, Human
uggguuauaauuuguuaugaaugaagauuuguuuucucauaaaaaugguaaccca

SEQ ID NO: 4201128 - RNA, 74 nt, Human
uggguucccucgaagagcuuauucuuucacuaauccugaaucuucuggugacugauugccugaugggggaaaca

SEQ ID NO: 4201129 - RNA, 72 nt, Human
uggguucuaggcaggcccucuggaaagguagcucaccuaacaaagcuccuccaucucagcaugccagaccca

SEQ ID NO: 4201130 - RNA, 57 nt, Human
uggguucuuucacuucucaguuucaugguagauuuugguccaaaaggaaagaaccua

SEQ ID NO: 4201131 - RNA, 59 nt, Human
uggguugagagcagacuuccagccacaagucuucagggcuacagaagcucuccuaucca

SEQ ID NO: 4201132 - RNA, 91 nt, Human
uggguugggccacuagugacuacagggacucccgcagagauaucaaauauuuccucauggagcucugugcucccucugaaggcucuuuuca

SEQ ID NO: 4201133 - RNA, 76 nt, Human
uggguuggugcaaaacuaguugcgguuucuggcauuuaaagaaugggaaaaccgcaauuacuuuugcgucaaccua

SEQ ID NO: 4201134 - RNA, 66 nt, Human
uggguuucaaaguggacaguuagucucauuguuacauguggugacauugaucauugugaaaucuca

SEQ ID NO: 4201135 - RNA, 63 nt, Human
uggguuucacaugaaaguaggaaaggacucucuggagucuuuaccaucuuuaugugagaaaca

SEQ ID NO: 4201136 - RNA, 55 nt, Human
uggguuuuaaacaugguuaaaguucuuaucccagagcucuaaaccacaaagccca

SEQ ID NO: 4201137 - RNA, 129 nt, Human
ugguaaacauucagggaaaaguuuauuacugacaugugagagcucgguuuucaagguuaauaaaauaaaguugacagaagucgugaugccucacaugacucagacccauuucuccuuuccuucguagca

SEQ ID NO: 4201138 - RNA, 55 nt, Human
ugguaaaugucuaacaaucacuggacaaaagagccauuauuugugauauuuaccg

SEQ ID NO: 4201139 - RNA, 69 nt, Human
ugguaacauaguuggagcaggcauucuccacggacacggagaagcuccgccugcccucugugauggcca

SEQ ID NO: 4201140 - RNA, 83 nt, Human
ugguaaccaucaaaaguaacagcaucuccacuggaaauugguacacaguccacauggaguugcuguuacacuugauaacacca

SEQ ID NO: 4201141 - RNA, 58 nt, Human
ugguaaggacuuaguuaucaauugacagcauaacugguaacauguaaguccuggauca

SEQ ID NO: 4201142 - RNA, 87 nt, Human
ugguaauguucucuucccuggcuggcugucaaggaaagccagagagaucuaucuucggcccucagccagcuggaaugggcacugcca

SEQ ID NO: 4201143 - RNA, 80 nt, Human
ugguaauuggacuuucuaggugcuauugugauuacaaaagacuguaauaugcgaugcuccugagacucuacacgaggcca

SEQ ID NO: 4201144 - RNA, 72 nt, Human
ugguacaaacagcaggaguaucuguaguagcaguagcggcaacugcaggaugugcuccuauugucugugucg

SEQ ID NO: 4201145 - RNA, 60 nt, Human
ugguacagcauuacaacuacuugugagaggagcuccuacaagagcaguaagcuuguccca

SEQ ID NO: 4201146 - RNA, 63 nt, Human
ugguacccuguggccagccagccaaauugaaacugaagugguaauugauaucaugggguauca

SEQ ID NO: 4201147 - RNA, 77 nt, Human
ugguacggauuuucagagacaucuggacuugccuucucugcacagucucagaauguccuugagacauugucguacca

SEQ ID NO: 4201148 - RNA, 55 nt, Human
ugguacugagaauagcgucuacaauucaguaggugcucaaguuuacaugugacca

SEQ ID NO: 4201149 - RNA, 102 nt, Human
ugguacuuccgcccucaggugauuuuaucuaauaaaucugauaaguacaguagacucugauacucggauauuagaugaauagcucaugcuguggggagacca

SEQ ID NO: 4201150 - RNA, 82 nt, Human
ugguacuuggagagugguuaucccuguccuguucguuuugcucaugucgaaucguacagggucauccacuuuuucaguauca

SEQ ID NO: 4201151 - RNA, 102 nt, Human
ugguagauuccuucuagugacuggucaccuucaggucugauuaccaaugcuagaaagcguggcuccuaacagaucugaaauuggucacuuaggauucuagca

SEQ ID NO: 4201152 - RNA, 61 nt, Human
ugguagccacuggggaagccagaucuaggcauguggccugauggcuccugcgguggaacca

SEQ ID NO: 4201153 - RNA, 62 nt, Human
ugguagcccagaggccagaagaggggcucuguuccuuucucuuguuuccuuugcgcuaucca

SEQ ID NO: 4201154 - RNA, 87 nt, Human
ugguagcucuuucuuucaaaucagucuauguuuccaggaaguagaaaauacugcuugcuggaggcagacagaaugcaagugagccca

SEQ ID NO: 4201155 - RNA, 59 nt, Human
ugguagcuuuguucuccuaaccccgagauuucuuggcuaugagaacugacagagugcca

SEQ ID NO: 4201156 - RNA, 75 nt, Human
ugguaggagacucagauggggggaugaaggaguccaaggcccagccucaccccuccauucucucaugucucgcca

SEQ ID NO: 4201157 - RNA, 72 nt, Human
ugguaggugcuggagucugggcaggauuugucugugucugcaucccauccucccaacuuuuccaucucaccg

SEQ ID NO: 4201158 - RNA, 75 nt, Human
ugagcaauuaacaaauguagcugugauagcuucugcccagaagucaaguccauaauuauuugcuuacuugucuca

SEQ ID NO: 4201159 - RNA, 92 nt, Human
ugagcacagcacagaguugcagagagcgucccuuaaaucaaugcaggcgaacagauuagcuacgcaucggccugccucgugcgcugugcuca

SEQ ID NO: 4201160 - RNA, 85 nt, Human
ugagcacagugccagcucugcagggccuggggucacugagaacucaaccgauccucugaccgcugcagggagucacuggugcuca

SEQ ID NO: 4201161 - RNA, 75 nt, Human
ugagcagcuggccuccggcagggccaggacugaagagaugucugaaguuaaaugcuggaagguccaauuugcuca

SEQ ID NO: 4201162 - RNA, 59 nt, Human
ugagcagcuuguuccgaguguuauuugguuccaaacccaauacuauuuucaacugcuua

SEQ ID NO: 4201163 - RNA, 67 nt, Human
ugagcaggaagagagugauucccucccauagaacuguauuuugaagaaggaguagcucuauugcuua

SEQ ID NO: 4201164 - RNA, 76 nt, Human
ugagcaggacugaccggccuuagaacgccgccgcccagaggucagaguugaggugggggccgguggggccugcuua

SEQ ID NO: 4201165 - RNA, 72 nt, Human
ugagcaggcaauggauauaaaagagauaagaacagaugaaccaaucucaguguuaucuaucugccuucuaca

SEQ ID NO: 4201166 - RNA, 68 nt, Human
ugagcaggggagagcgaauguguguccacuuacaugucuguguuugcauguuccuccucuucaguuca

SEQ ID NO: 4201167 - RNA, 83 nt, Human
ugagcaguaaugacugaggugugagccacuuccccaggauuaauaaagagccggggaguugacaguuuagaccauuaggcuua

SEQ ID NO: 4201168 - RNA, 63 nt, Human
ugagcagugaugcguuuuguuucaaaagagaaucaccaacagaaagggauugcucauugcuca

SEQ ID NO: 4201169 - RNA, 82 nt, Human
ugagcauaacaguccacaggggcccacgagccgcuucugcgucccaagcccucguuucugcauccugucuucacucugcuca

SEQ ID NO: 4201170 - RNA, 58 nt, Human
ugagcauggugggugcagagcaggcagggcacugucagcgucugcugcguauauguca

SEQ ID NO: 4201171 - RNA, 61 nt, Human
ugagccaagacggggacccucaccagacaucaaaucuacuagugcuuugcucuuggacuca

SEQ ID NO: 4201172 - RNA, 59 nt, Human
ugagccaagauugugucccugcacucaaguaugggugacagagugacacucuugucuca

SEQ ID NO: 4201173 - RNA, 61 nt, Human
ugagccacaucugcuccagcaguggaccccacccacugcacaggugagauguggggccuca

SEQ ID NO: 4201174 - RNA, 83 nt, Human
ugagcccuaagaacuaguaggauugagaggauuaggguaaagaggguaaaccuacuccaugguuucagucuggcuggagcuca

SEQ ID NO: 4201175 - RNA, 63 nt, Human
ugagccuaggccuugcuaugaagcaguguccaaauggaaaauguugaaugaaugucuggcuca

SEQ ID NO: 4201176 - RNA, 63 nt, Human
ugagccuggagcccagauguuuucucugggaagaggagcaaauguuauuggcugcaaggcuca

SEQ ID NO: 4201177 - RNA, 68 nt, Human
ugagccuuagcaucuuaaagcugugauugaucuugauucucacccacauuucuuauggauguuggcca

SEQ ID NO: 4201178 - RNA, 61 nt, Human
ugagcgcaggaaaggccuuuugaaguggggacaguuuuaagaggcagcauuccucgccuca

SEQ ID NO: 4201179 - RNA, 57 nt, Human
ugagcggagccgcggccguccuggcauuuuaaaggcgaggcagcuggacgcuguuca

SEQ ID NO: 4201180 - RNA, 106 nt, Human
ugagcuaagaggcuagugaaaucuuuagucaggcguggguauuggaaauacuucuuuucugguccuguguacuccugauacuugggauucauuugcucaucucuca

SEQ ID NO: 4201181 - RNA, 65 nt, Human
ugagcuacuaaaugcauuuguauuuuugcagcauauacugucuuguauuuugcaauuaugguuca

SEQ ID NO: 4201182 - RNA, 85 nt, Human
ugagcuagaaauaauauagaauuuauuagaacuacugaaugcccucaguacuuuuuugauaucugaguuucgacuugauagcuca

SEQ ID NO: 4201183 - RNA, 71 nt, Human
ugagcuaggguuagagaugucuccugcacauuacuuagcaauagaaaguguucuacacuuugaccuugucg

SEQ ID NO: 4201184 - RNA, 69 nt, Human
ugagcuauuguugaaguuuuauagggcgaauucauuccauuuacuacuauaaagucuuaaugagucuca

SEQ ID NO: 4201185 - RNA, 60 nt, Human
ugagcuccggcauauggaauuagcaugauagaaccaugacaugccaagugccgggagcca

SEQ ID NO: 4201186 - RNA, 117 nt, Human
uguaaccacuguccuuaacgaguacauagauuuguuuccuucucuccaggagcaugagauuuguugccuccaggaaaggcaacaaaucuacguauuccuuaaggacagugguucuca

SEQ ID NO: 4201187 - RNA, 59 nt, Human
uguaaccuuacauggcagaaaaggaaaauagcuuucaugguuucuguuagaaggauaca

SEQ ID NO: 4201188 - RNA, 64 nt, Human
uguaacuggaagccagccacacccguucuguauguuguguugucuguggcugcuuccagguaca

SEQ ID NO: 4201189 - RNA, 128 nt, Human
uguaacuggucacagcaauguuuucuagacuagugagugugugcucauacagcaccauguguguucaacaacacacaaaguuggaugacaaaaucacuuuagugagaaggcagcuauuuccaggggca

SEQ ID NO: 4201190 - RNA, 57 nt, Human
uguaagccuucccugagaaagucugagauugacauccuccucugggagaggcauaca

SEQ ID NO: 4201191 - RNA, 78 nt, Human
uguaaggcuaguaucaucuacuuuugaaaacauaauuuuuaugauuagcagguaaagguagcaugaaacugcaauaca

SEQ ID NO: 4201192 - RNA, 69 nt, Human
uguaaguggcaaagcaagauucagauguagguugaucccauucuaaaaccuuugcuuuuucuacuugca

SEQ ID NO: 4201193 - RNA, 61 nt, Human
uguaauauauauaaggagcuuuaagggacuuuuuccucgaaaugcucucuaauguaauaca

SEQ ID NO: 4201194 - RNA, 129 nt, Human
uguaauaucaaaacuaaaauggaaauuuuucaucuguaguuuuuccaagguugugugggguuagaugugauaacauggugcaccaaggugaaguggcagaugagagagacagagaauacaaugacugca

SEQ ID NO: 4201195 - RNA, 128 nt, Human
uguaauccagcuagugguucguagguauggcuccccuacugcauggggaaccuuggacuguaucuuucucauuucugucucccugauguagagcaggccugccucaauggauacuaguugaaugaaca

SEQ ID NO: 4201196 - RNA, 56 nt, Human
uguaauucuaaccacauagguguaacaggaagccacugaugcuggucugaauugca

SEQ ID NO: 4201197 - RNA, 56 nt, Human
uguaauugagcauccagaguauggagaaguaauucagccucagggugaccaaugca

SEQ ID NO: 4201198 - RNA, 98 nt, Human
uguaauuuacucugcauccccaggaagaaauucugauuugccugaaucacaguguaaguaggcauguuucuauuuugguacuuguaaguaguauuaua

SEQ ID NO: 4201199 - RNA, 68 nt, Human
uguaauuuauugucaaaaacaggacacuuuggagaacuaaaguggacguuggugauaauuaagcugca

SEQ ID NO: 4201200 - RNA, 123 nt, Human
uguaauuucuucagaagcgguaguuuugagguaucugucuuuaauugugggauccuguaggugcagacaguaugguucugguaauuuaaggcaccucagagcaucaccuuuugcugaucugca

SEQ ID NO: 4201201 - RNA, 65 nt, Human
uguacaauauauaugauuuugaguacuaauauuacacagugaauucagaauuguguguuuguaua

SEQ ID NO: 4201202 - RNA, 69 nt, Human
uguacagacuauuuugugauaacuaaucuguucucuuugacuauuacugaggcaaaguaguuuugugca

SEQ ID NO: 4201203 - RNA, 57 nt, Human
uguacagacuuugcagugugcagagucaaaucucucauauccuguaacuuugcugca

SEQ ID NO: 4201204 - RNA, 77 nt, Human
uguacagcccaagucucugaggcaaaauccggaagauaagcgugucuucuguuaccacagcgaugaggugcugggca

SEQ ID NO: 4201205 - RNA, 61 nt, Human
uguacaggagaacaaugagaaaugguuaccaaugacaaacuuaucagguguuuucuguaua

SEQ ID NO: 4201206 - RNA, 75 nt, Human
uguacagggcaugugcagacacauaugugcacacuaugucgcacacauucaaaugugccugcacaugucuuugca

SEQ ID NO: 4201207 - RNA, 62 nt, Human
uguacaguaggaacuuguuauucauuuguuucuccaaauauuuauugaguaccuacuguaua

SEQ ID NO: 4201208 - RNA, 77 nt, Human
uguacaguaugugaucuuacugaauauuguaggcaguuauaacacaaugguuacacaguauaugggaucacaguaua

SEQ ID NO: 4201209 - RNA, 90 nt, Human
uguacaugcugcaccuuuucucuagcaggugccuuguaacaguuagaugccuauguggccgcaccugcagaggugaggugcuugggugca

SEQ ID NO: 4201210 - RNA, 58 nt, Human
uguacaugugucuguauaucuuuggagaggcuuacaugauuauggagaaauauguaca

SEQ ID NO: 4201211 - RNA, 113 nt, Human
uguacauugccaaaacucugggagaaaucaugggaaauggaaugagggggcugacugcagcugccugugcacuuucucguaauuuccauguuucuaguagcuuggcagguaca

SEQ ID NO: 4201212 - RNA, 103 nt, Human
uguaccuagaaucuuuucaagggcuugaggucccucugucuuaguaauuagacaaauucuguagccaguuuggccucacccugacaaagauuuucuaucuaua

SEQ ID NO: 4201213 - RNA, 55 nt, Human
uguaccuagcaugugcuuuuccucuagcagugggaggaaguggcacaggagugca

SEQ ID NO: 4201214 - RNA, 82 nt, Human
uguaccuguccucaccugcuaccaguuguuuuaugagauaauaaauguauuaaguaaagcagguaguugggacacagcuaua

SEQ ID NO: 4201215 - RNA, 79 nt, Human
uguacucauuugcguguguguguguguguguguguauacucaguugugugcaguuuuaucacauauauagguuuguaua

SEQ ID NO: 4201216 - RNA, 68 nt, Human
uguacugccuguuuucugauagauuuuuucuacaaagauuuguauuaccaggaaauaaugcuaguaua

SEQ ID NO: 4201217 - RNA, 55 nt, Human
uguacugcuugugaauaugaauuuaaauguuauguccagggcacacagcagugca

SEQ ID NO: 4201218 - RNA, 73 nt, Human
uguacuguguagucuagugagucuccccuguuauuuugggaaccauuccacagaagcucaagagagcagugca

SEQ ID NO: 4201219 - RNA, 67 nt, Human
uguacuuacaaacauccaggagagucugagagagaucuagugacaccguggaguugugcugaguaug

SEQ ID NO: 4201220 - RNA, 60 nt, Human
uguacuucuggugacuuuauagaucaaauaacauuuugaauaaaguuuuacaggaaugca

SEQ ID NO: 4201221 - RNA, 105 nt, Human
uguacuuuguguucucugauugcugaagcauacuuucuauacugcuauaguccuuuaguauaugcuucuguaugucucacagcuguucaugaauucaaaguaaca

SEQ ID NO: 4201222 - RNA, 75 nt, Human
uguagagugcuuuucagaaagaugagaaauuacuugagccagugagguguuuucucuugaaaagcaguccucuca

SEQ ID NO: 4201223 - RNA, 77 nt, Human
uguagauaauaguguuacccuucuuaaaguccaagccaacuggagcccugcauagaagggaacacuuucuaacuaua

SEQ ID NO: 4201224 - RNA, 57 nt, Human
uguagaugacauguaaaugaaugaacauaguucuguuccaauaaaauguuauuugca

SEQ ID NO: 4201225 - RNA, 71 nt, Human
uguagauguccuguggugugucucacaaaugcacaugcacaugcaugcgaacacacacacaaacacgcaca

SEQ ID NO: 4201226 - RNA, 80 nt, Human
uguagcagagagcacauaggauacuuuauggaaaagagaaaaaagcacuuucugagaagucuuauugugccucuuauaca

SEQ ID NO: 4201227 - RNA, 81 nt, Human
uguagcguugagaaaguuauaucaucucauugacgaggaaaccaguguccagaaagguaauaugacauccucaaggcagca

SEQ ID NO: 4201228 - RNA, 70 nt, Human
uguagcugguccugcagaagaguccagcucauuugaaagaaugaucuggggacauucucugccuaguuca

SEQ ID NO: 4201229 - RNA, 75 nt, Human
uguagcuuaaguaauaaauaaguuuucgcugucccaagcucuugagauuuuaggcuuguuuuacuaaaagcaaca

SEQ ID NO: 4201230 - RNA, 66 nt, Human
uguagcuucuccuuucauucccuguagaaucugucuuguucucauggagucaggagcagaaauaca

SEQ ID NO: 4201231 - RNA, 91 nt, Human
uguaggaagauguuuaagaucuugucauuucuaauucucucccaagugaggaaggaagugaccaggauaucccuaacauuuggauccugca

SEQ ID NO: 4201232 - RNA, 57 nt, Human
ugguuggagcuccauguccccgggccuguaaggaauuagugcccucagcuuuaacca

SEQ ID NO: 4201233 - RNA, 84 nt, Human
ugguugggaaauuucccuuaaagcaaguuggaaaauuuggaaauuauaucaccacuugaaaaucagaggaaauuuucccaagca

SEQ ID NO: 4201234 - RNA, 61 nt, Human
ugguuguauguuucaguguuugacuggcuaaauaccaaguaaaugcuccauacauacacca

SEQ ID NO: 4201235 - RNA, 78 nt, Human
ugguuguuggcugaccugaucaugccuuucucuuuuuuaaaggcuuauagagaaauguacaaaagucagccaacucca

SEQ ID NO: 4201236 - RNA, 65 nt, Human
ugguuuaccuggaaaagcgcauuauaacacagccuuggaaauuuuguguucuucuaggucagcua

SEQ ID NO: 4201237 - RNA, 80 nt, Human
ugguuuauguuucaucaguaagguuuugguauucauuuucaggagcuucagaaaaguuugaugagcuauuauauaagcca

SEQ ID NO: 4201238 - RNA, 87 nt, Human
ugguuucagcugcacaaggugucauccaggauggugggauuuauuucaccccuaauugcgccauggcagccagcuuuauagaaacua

SEQ ID NO: 4201239 - RNA, 101 nt, Human
ugguuuccaucugcgcagccauuucaacaaccggcugcugucaccccagcuccaaaacagcagcgaggugaugaaauagcuuugucaaggugagaaaacua

SEQ ID NO: 4201240 - RNA, 92 nt, Human
ugguuucgacuaagauaggagggguggaaauagcaaaaugguagugcuugcauguugauuuuucucuccacuccauuaaaucuagggaacca

SEQ ID NO: 4201241 - RNA, 64 nt, Human
ugguuucugcuuauucaaaugaucuuuccaauuuugauugagaggauuuugagaagcaaaacua

SEQ ID NO: 4201242 - RNA, 82 nt, Human
ugguuugagaagacucuuggucauuggcauuaagugauauauggcuuuucaugcacaaaugagcaaggaaaauuucaaacua

SEQ ID NO: 4201243 - RNA, 61 nt, Human
ugguuugcggcuaucacacagccagcuggaguucacucuggugcucagugaugccagacca

SEQ ID NO: 4201244 - RNA, 80 nt, Human
uggcaagaguacauuaggaaauuccaccuguauucugaauguagcagaauucuaggguaaauauccuaugcacucugcca

SEQ ID NO: 4201245 - RNA, 64 nt, Human
uggcaagcagagucugguggggggccuuaaacaaagcucacccagcaugucuucugccuugcca

SEQ ID NO: 4201246 - RNA, 63 nt, Human
uggcaagccgcuggcucccagaaauguuuugguucccccucagcucugggaagccgggcucca

SEQ ID NO: 4201247 - RNA, 96 nt, Human
uggcaagucuauuaauagcuccuagaacagaguuccagugaucauugugugaugaacacugaaggucuuuuucaaaagcuuugaagguucuuguca

SEQ ID NO: 4201248 - RNA, 127 nt, Human
uggcaaguggauaaguaauguugacuuagaguucauuuuucccuaaugaguaccuaggggacucagugacagcucuggggagaaaugggaaggaucuuaaauugauggaaaaaacucacauauguca

SEQ ID NO: 4201249 - RNA, 100 nt, Human
uggcaaugugcauuauguguuuguuaagggguaucaagauguggaagacaucaucugugauucuucuugagucuuggacucuguaaaauccacauuguca

SEQ ID NO: 4201250 - RNA, 79 nt, Human
uggcaauugcuuuugcuaggaacaacaugauagagaauugauuuuuuaaauguguucuuaguagcuaaagcuaccacca

SEQ ID NO: 4201251 - RNA, 69 nt, Human
uggcaauugugaucugggaauucccgagcauuuuccuguauucucuggaguccuguaucacuccugcca

SEQ ID NO: 4201252 - RNA, 55 nt, Human
uggcacagacugggccaaggaaacuccacaugaaucccugguccagguggagcca

SEQ ID NO: 4201253 - RNA, 86 nt, Human
uggcacagcugugaagcaagcacucuaguuagugucuuuuccccucaucuuugcugaccuccggaggcaugcuucaugcugcucca

SEQ ID NO: 4201254 - RNA, 65 nt, Human
uggcacaguacccagggcuaguaaaaagggccugggccuauuauuuauugcuagcccuuggucca

SEQ ID NO: 4201255 - RNA, 74 nt, Human
uggcaccagggugcuguguucuggcaggugcaauauaaauccagcucauucagaggacaagcucccuggugaca

SEQ ID NO: 4201256 - RNA, 56 nt, Human
uggcacguuggauugggaguucgcgucguggaugucucauacguuuccagguguca

SEQ ID NO: 4201257 - RNA, 63 nt, Human
uggcacugcacuuuaagauuuagcucguguuugauucaagauuaaguuuuacaguguuuguca

SEQ ID NO: 4201258 - RNA, 59 nt, Human
uggcacuggaaucguagccuugguugugacccugaucagggaggcaggcuccagggcca

SEQ ID NO: 4201259 - RNA, 64 nt, Human
uggcagaaagugcuuucucuccagcauaaacaauguacucucaagagaagaggacuuucucaca

SEQ ID NO: 4201260 - RNA, 68 nt, Human
uggcagaaauaccuuauuuugaaauagauuguggcaggacauguaacaagaaauaaguuauuucccca

SEQ ID NO: 4201261 - RNA, 79 nt, Human
uggcagaauucucucagaguccccacaucugggucucuucccuuuuggaggcugggauggcggagacugugagcugcga

SEQ ID NO: 4201262 - RNA, 57 nt, Human
uggcagaggaggcucagauugaggaaacaaucccucauggaaugaauucuucuguua

SEQ ID NO: 4201263 - RNA, 87 nt, Human
uggcagagggucaguaagaguagaggaguuaaagagaaauguacuauucccuuuugacccuguuauucucccugaccuagauuguca

SEQ ID NO: 4201264 - RNA, 60 nt, Human
uggcagaggucaaauaccucauuuccaaugccuugaggaaaauggucugugauucuguca

SEQ ID NO: 4201265 - RNA, 60 nt, Human
uggcagagugcggcauccccugucaaccugcugugguuuccuggugggcucacuuugcca

SEQ ID NO: 4201266 - RNA, 58 nt, Human
uggcagaguuauggguauuuauaauuuuauucuuuguagcuuucucaauuuucugcca

SEQ ID NO: 4201267 - RNA, 59 nt, Human
uggcagaguucgcugugccuuugguauagaaaucacaggucacaacaguacuuuagcca

SEQ ID NO: 4201268 - RNA, 67 nt, Human
uggcagcaaccaaccaggcauuuguaccagcucuuccuccacuccacagguccuuugguuguuggca

SEQ ID NO: 4201269 - RNA, 57 nt, Human
uggcagcacggcauccacucucucaauuugauccagagugaaagcauguugcagcca

SEQ ID NO: 4201270 - RNA, 102 nt, Human
uggcagcauggggagaagaaggagacccugaagaugcugaugacaauggugcuugucuacacaaucagcuggcucccucuuaaccucuaccuggugcugcca

SEQ ID NO: 4201271 - RNA, 94 nt, Human
uggcagccuucuucggggcagcugagcagggcaggaccggaggggggccacuggugccugcuuucugggcugccauugugggugggcauagcca

SEQ ID NO: 4201272 - RNA, 60 nt, Human
uggcagcuccucaaaaaauuaaacgugaauacgaaauuauuuaaugggugaggaguuuca

SEQ ID NO: 4201273 - RNA, 76 nt, Human
uggcaggaggcaggugcccugucuguaccgugaugagccguaagaagacugcauagacaaagcgccccuccuccca

SEQ ID NO: 4201274 - RNA, 55 nt, Human
uggcaggucagaauuugaauuugggucuguagaugccacauuuuacuguuugcca

SEQ ID NO: 4201275 - RNA, 83 nt, Human
uggcagugacugcuagcuguccuccaaugcaugcugccccugccacgguauggaaaugucacugugaggcagcugucaugcua

SEQ ID NO: 4201276 - RNA, 130 nt, Human
uggcagugauaacugaaaggggcucaugauuccacaggagcugguuuucuucuccaugacuuuuccaggaccagaaaaagcuguauccugauugggugacagacguccuuggagcuauugcugcagaucg

SEQ ID NO: 4201277 - RNA, 67 nt, Human
uggcaguggcuuugcugguggagaagagggccuuucucuccgcucauuccagaaaggccacucaccg

SEQ ID NO: 4201278 - RNA, 56 nt, Human
uggcaguuuuguauuugagcauuucuuacuggaaauguuaauuacaaaaugugcca

SEQ ID NO: 4201279 - RNA, 72 nt, Human
uggcauaaaacagaaauucuuucuuuaaguguguucaaucugguugcuuaggaaaguuucugcuuaugucca

SEQ ID NO: 4201280 - RNA, 70 nt, Human
uggcauaauuucagucuuauuuuguugauagcuguugagcauuuuguccugcagaauaaguugagaacca

SEQ ID NO: 4201281 - RNA, 77 nt, Human
uggcauagagcaagcccuccguacgugcuagcuuuuaguauuauuuuuagaguggugcacacagcagggcuuugcca

SEQ ID NO: 4201282 - RNA, 91 nt, Human
uggcauagaugaggagcuuaaagcuagcgcugcuuggaaggauuuuuaaaaaucuacagccagucugguuuguagcaucgguuuagggcca

SEQ ID NO: 4201283 - RNA, 80 nt, Human
uggcauauccaguugauguaauacuuugcaaccauuaaauugauguuuacaaggaguuuauauugacauuggugaugcua

SEQ ID NO: 4201284 - RNA, 75 nt, Human
uggcauaugaacacuuuggaauagagauaggcauuccaggugggagucugugucacaggcuaaagugugauacca

SEQ ID NO: 4201285 - RNA, 59 nt, Human
uggcaucucacauaugacaucgccaaugguguguuugcaaccccuugugagaaugucca

SEQ ID NO: 4201286 - RNA, 89 nt, Human
uggcaugacagagggcuccuacaguguuugaguccagaaucagaggggauccgcuggcuuccaugcuguaguggcuuuuauacauucca

SEQ ID NO: 4201287 - RNA, 60 nt, Human
uggcaugauuacuacuaaucaggaagcuaagggcauugauuagacaaaggaaucaugcua

SEQ ID NO: 4201288 - RNA, 69 nt, Human
uggcaugcaggggcuuuuccucuauaaggggcugucacuguccacuguuuaaagccucugcuugagcca

SEQ ID NO: 4201289 - RNA, 66 nt, Human
uggcaugcugagguuucgucugcuugcacuucuacauggugcaagcauggggcacugggaaagcca

SEQ ID NO: 4201290 - RNA, 62 nt, Human
uggcauguacccaggaauggacaaaccuugcccuacgcagcaucauucuugguuggauggca

SEQ ID NO: 4201291 - RNA, 55 nt, Human
uggcauuguggugugugcuuccuagaacaauaggccaucaaaucauguagugcca

SEQ ID NO: 4201292 - RNA, 56 nt, Human
uggccaauggggacuaggguuguauaauuggaaaauacagucuccccuguugucca

SEQ ID NO: 4201293 - RNA, 57 nt, Human
uggccacugggccuacccagauuggcagacagaaggcugccuuucccccaguggcca

SEQ ID NO: 4201294 - RNA, 63 nt, Human
uggccagccauaaaagaacccaaguuucucagcucauaggccagguucuucagugguugucua

SEQ ID NO: 4201295 - RNA, 58 nt, Human
uggccagcccuucagccaugccugauagaaggucgcaggcaggcugaggcaguggcca

SEQ ID NO: 4201296 - RNA, 69 nt, Human
uggccaggcacagugggguccucucuggugggugugagccgcagggaccugccacugcugucucugcca

SEQ ID NO: 4201297 - RNA, 61 nt, Human
uggccaggcagguagaacggcccugcaccccauuuccagggccuucagcaggucuggacca

SEQ ID NO: 4201298 - RNA, 76 nt, Human
uggccaggcaguguuuuucucacagguugcuugacuaauggcugugugccugugccaaaaggcugcuuauggguca

SEQ ID NO: 4201299 - RNA, 62 nt, Human
uggccaguugaagacaaugcucacuuacuacgagauaaugugcguguugucugaagcugcua

SEQ ID NO: 4201300 - RNA, 59 nt, Human
uggccaugaaggaggcagcagaggagaucccaacucugcuacucaccaaucaugagcca

SEQ ID NO: 4201301 - RNA, 68 nt, Human
uggccccacagggccuuuucagaccagcagcccuuuccggccugcacugcccugggccuauggggcca

SEQ ID NO: 4201302 - RNA, 76 nt, Human
uggccccucaaguggaguuacucagggcgcgguccuugggcccuuucucugcccucaguuucacaugagugggcca

SEQ ID NO: 4201303 - RNA, 69 nt, Human
uggcccgaccacaggacaccuuagcuaaaauucagaaacuuuuggauauuguuuugguuccucaggcca

SEQ ID NO: 4201304 - RNA, 70 nt, Human
uggcccugcccccugguggccagagccggcuucacaggacaagagccagcuaaguuccaggggcuuucca

SEQ ID NO: 4201305 - RNA, 55 nt, Human
uggcccugcuaugauccugcaaaggucauccugaucccaggauuagagagggcca

SEQ ID NO: 4201306 - RNA, 63 nt, Human
uggcccuggagagggauauggcauauuaggggugagauaaugcccucccauuccugguaguca

SEQ ID NO: 4201307 - RNA, 69 nt, Human
uggcccuggcacaucuaacucacucuccccacuggcuguggaaaggcagaagucagggugccagggcca

SEQ ID NO: 4201308 - RNA, 59 nt, Human
uggcccuucaaauucccuagucuucauuucagccuggcuagaaggggagauugaagcca

SEQ ID NO: 4201309 - RNA, 77 nt, Human
ugagugucggcugagcaauuuugaugacauugagcaacagcacaacaauguuacaauucaaaaugcugcugauugca

SEQ ID NO: 4201310 - RNA, 61 nt, Human
ugagugucuguggggcauggacaugaccuggauauuaggaugucagcgaucagagaacuca

SEQ ID NO: 4201311 - RNA, 67 nt, Human
ugagugugaccucaucuuaacuggaacccaucugcaaagauccuauuuccaaagaaguucacauuua

SEQ ID NO: 4201312 - RNA, 57 nt, Human
ugagugugcucccuguugcucaggucugagcugagcacaugcacagugcuacacuca

SEQ ID NO: 4201313 - RNA, 62 nt, Human
ugaguguuucuggggaaagagcugccggaggaguggagcuacuucccuguaggaaacacgca

SEQ ID NO: 4201314 - RNA, 83 nt, Human
ugaguguuuggaauccucaguaugaucagggagggcacucagagagaagagcuggaaugaucuaugugaggguuccccauuca

SEQ ID NO: 4201315 - RNA, 69 nt, Human
ugaguuaugcaugagauaaaaauuggcagccauccuugugcucucagcucuugguuaugcaugaaugca

SEQ ID NO: 4201316 - RNA, 95 nt, Human
ugaguuauugcuuucacucuguguuucugcagcucucucugccuguuuuuaccacuggacaggaagcuccaugaaggcagagucaguuugacuua

SEQ ID NO: 4201317 - RNA, 79 nt, Human
ugaguucucauuccuuggcugguauugaacuccaucccaaaaacggggcuuugaggacacacaaagagugagaacauca

SEQ ID NO: 4201318 - RNA, 71 nt, Human
ugaguuguucuaacauuuuaaagucaagggauugaaguuccuggcaguaauuugauguugcugauaacuca

SEQ ID NO: 4201319 - RNA, 55 nt, Human
ugaguuuaugucuuucauuguucuuuguccacaaaggacagugagacauaucuca

SEQ ID NO: 4201320 - RNA, 76 nt, Human
ugaguuuuggaagacaacacaaugcaacagaaggaacacuaauuuugaagcugguagguuuuguuugcagaacuua

SEQ ID NO: 4201321 - RNA, 64 nt, Human
ugauaagaaagcccucacauuuuaggaagaauccuacagugucgugugguuucugcucuuguua

SEQ ID NO: 4201322 - RNA, 85 nt, Human
ugauaagcugugcuuuaaaauuagcuuuaaaccacagcaguccuaaaaugaggauucugugaguucuaguuaauagucagcauca

SEQ ID NO: 4201323 - RNA, 67 nt, Human
ugauaaugggggugccacucagcaugauaaauguucaggaugcuggaggggguaccacucaacauca

SEQ ID NO: 4201324 - RNA, 78 nt, Human
ugauacaugcaauagcaauuuugaacuauaaugaugauagcuuuauugagcauuguucaaagugcuuugcauguauua

SEQ ID NO: 4201325 - RNA, 68 nt, Human
ugauacugaugaaaaccagaacucucauugauaaugcauugucugguuucauuuuccagguaguauca

SEQ ID NO: 4201326 - RNA, 73 nt, Human
ugauacuuggauguuggcagaauuagaaguauggccaguguaacaggacaggaucugccaauauucaaccuca

SEQ ID NO: 4201327 - RNA, 67 nt, Human
ugauagaagguaugugaauuagacaguuggaacagccaaagugucuuuuggagcaucuuucuuguca

SEQ ID NO: 4201328 - RNA, 64 nt, Human
ugauagucuucaucucugccuuggccacauuuuggcccagaugaggcagcgugagggccacuca

SEQ ID NO: 4201329 - RNA, 83 nt, Human
ugauaguuggagcugcagucuaccuggauuuuuauuuaaccaagugaguagauccaagacuguccuauagcuucaaucauuca

SEQ ID NO: 4201330 - RNA, 69 nt, Human
ugauaugcaggcagaacugagaaucacugauguagaagaacaauguuucucaguuuggucugcagacca

SEQ ID NO: 4201331 - RNA, 76 nt, Human
ugauauggagguacugaaaaaauguuugcauuauuuaaagugacaaauguuaauucaguggauaagcaaccuguca

SEQ ID NO: 4201332 - RNA, 129 nt, Human
ugauauuacuaaaguggaggcagcucuaggaguggggacuguagacaucagccuguaguuguugguaccaacuguaauugaaaguuugagucaucuguuuaaagaaugggccuuuccuucaucauguca

SEQ ID NO: 4201333 - RNA, 94 nt, Human
ugauauuccugccucagauuuacugugucuuuccuacuuugugggcaacauguucacagggauggaauagaaauaagaaaaggcuggaauauua

SEQ ID NO: 4201334 - RNA, 93 nt, Human
ugauauucuuugaugacauuuucauguugacagguaguuuugguaaucccaaacaaaguaguuagucaugugaaaaugucauauagccaguca

SEQ ID NO: 4201335 - RNA, 70 nt, Human
ugaucaaagcacacuuagugguagaaccgggucuugaacuucauucuucuaccuccaagugucucuggca

SEQ ID NO: 4201336 - RNA, 71 nt, Human
ugaucaaagcgacugcagguuaaaacaagcaugcagagcacuuucagaaucuugagcagucguugguauca

SEQ ID NO: 4201337 - RNA, 58 nt, Human
ugaucaguagcagaaagcaaugagugucuguacaguuacuuaacuuuguugcuuauca

SEQ ID NO: 4201338 - RNA, 77 nt, Human
ugucucccucagccuggcugggaagagccucucaggggagguguugaccaagcuggucuagaagugugugggaggca

SEQ ID NO: 4201339 - RNA, 56 nt, Human
ugucucguugacccaguuuaucuuccucaggauaaacugugcuggaugaugaggca

SEQ ID NO: 4201340 - RNA, 62 nt, Human
ugucucucuuggagaguccaucaucacugucccaguugagccaugggacuccaagggagcca

SEQ ID NO: 4201341 - RNA, 97 nt, Human
ugucucuguggagcuggauuuugggcauuugaaguuagauuuuuuuaaguuuaauuugauucagcaaauguucacugagcuccugcccugagagaua

SEQ ID NO: 4201342 - RNA, 82 nt, Human
ugucucuuggagcaaccuacucuggcagguuugugccuuggcuggcacaggagguuaggaaguggucgguucccagagcaca

SEQ ID NO: 4201343 - RNA, 68 nt, Human
ugucugaaucucgguuuccucaucuguaaaauugguccagauagauacauaacucgagguuguagaca

SEQ ID NO: 4201344 - RNA, 76 nt, Human
ugucugaauuaguuuccuacuucuaaagugaaauuaguaauaacuaguuucuagacaguaagaauuuaaugagaua

SEQ ID NO: 4201345 - RNA, 57 nt, Human
ugucugauagacugauucauugacauacaaacuuggugauucucugacugucggaca

SEQ ID NO: 4201346 - RNA, 76 nt, Human
ugucugauggaucagaauguuuuggugugcucaccaggggcucuggagaacuagaauguucugauggagucugaca

SEQ ID NO: 4201347 - RNA, 79 nt, Human
ugucugauuuucucauagcuucugucuggaugguuucaaaaaacuaaucauuccacagcuacguuuugagcaucacuca

SEQ ID NO: 4201348 - RNA, 84 nt, Human
ugucugcuaguguauugagcauccacuguaugcaguucccugcgcuuugaguacuuuggauccuuacaauagcacuuuuagaua

SEQ ID NO: 4201349 - RNA, 79 nt, Human
ugucugcuuggguccuggcauggguuuaucauuggagucauuucauucauuguucugccgcugagcccagcugcagaua

SEQ ID NO: 4201350 - RNA, 92 nt, Human
ugucuggcacauagcaaauucuaugucaauguuuauuaaaugaaaauaaaguucuuucagaugaggcaggaguuugcuuguguuucaagaca

SEQ ID NO: 4201351 - RNA, 69 nt, Human
ugucuggcacuaagguuacagaaauggguaaaacaugagcccagucccuguggaacuuagugggagaca

SEQ ID NO: 4201352 - RNA, 71 nt, Human
ugucuggccccagaagggcuguagaucauuugcacucacagauugcuggaugagcucuuggaugccagaca

SEQ ID NO: 4201353 - RNA, 63 nt, Human
ugucugggaguucaugaguucuuaauccucugucacuggaacagacuuagagcaucccaauca

SEQ ID NO: 4201354 - RNA, 72 nt, Human
ugucuggguaagagggaagugaaagagaaccuuagcuucgaguguucaguuugacaaccuuuauauuuuaca

SEQ ID NO: 4201355 - RNA, 70 nt, Human
ugucuggguuuugggucauauuuaguaaagacauuacuuuauguucuuagauaccaagaagacccagaua

SEQ ID NO: 4201356 - RNA, 56 nt, Human
ugucuguaaccauuuucaacaguauaauccagcugucuuugaaugggcuguagaca

SEQ ID NO: 4201357 - RNA, 55 nt, Human
ugucugucaucuguucagugcucaauaaaucuuggccuaaaaaugaugacaugca

SEQ ID NO: 4201358 - RNA, 72 nt, Human
ugucugucaugcccauuuucuucuuugucugaagcaaucucauaccgacaaaguuugugguauuccaagaua

SEQ ID NO: 4201359 - RNA, 129 nt, Human
ugucugucuggagauuugaguuguucuugcuaucucccuuuucucuguuagcaaagucagcaaaugguugaaucaagguagacaaugaaguauuccuguuuguggucuccaguuucuguccuauagaca

SEQ ID NO: 4201360 - RNA, 57 nt, Human
ugucugugcccaaggcucccgggauuagcacaaucagcagguggcuggggacggaca

SEQ ID NO: 4201361 - RNA, 66 nt, Human
ugucugugcuuauguuuccuuauagggaaauaauauuauuugccacaggaaguuaugaguacuaca

SEQ ID NO: 4201362 - RNA, 84 nt, Human
ugucuguuuguuuuguuuucauugucaauaaacuguaucuagaugcugggugaaguucuacagaaaaauuugacauaaaagaca

SEQ ID NO: 4201363 - RNA, 58 nt, Human
ugucuuagugucuugggcuuuuucuucuggccaaaaccagagagugcagacacaagca

SEQ ID NO: 4201364 - RNA, 56 nt, Human
ugucuucaaugcauucucuuguuuaaggaauuaaaggagaaugcauuugaaaagca

SEQ ID NO: 4201365 - RNA, 113 nt, Human
ugucuuccaguuaucugcauugaaugggucuaccuggaaugaugacacacacacacucacacaugugugugcauacacacgguaacacaugguaauguagauuacuagguaca

SEQ ID NO: 4201366 - RNA, 68 nt, Human
ugucuuccaucacuaguccugcagggccugaacuaagccagcugcaucauuggugauucaggaaaaua

SEQ ID NO: 4201367 - RNA, 61 nt, Human
ugucuucugucugucuggcaugugucuuauuugaggguaaaugccagggagacaggaacca

SEQ ID NO: 4201368 - RNA, 74 nt, Human
ugucuucuuccauuguacuauauauguguaaauaaaguaauuugcauguguuucccagcaagcuuaagaagaua

SEQ ID NO: 4201369 - RNA, 66 nt, Human
ugucuucuuugucaucuuagguucauuggcugcggcuccuguagcaaaagauagauuaacaagaca

SEQ ID NO: 4201370 - RNA, 63 nt, Human
ugucuuggguguuuuaaaacuagauucuuuacuagaacuguugcaaaaaaaagcccagugaca

SEQ ID NO: 4201371 - RNA, 59 nt, Human
ugucuuuaagcaaacaguguuuguguaaccaccuuguagcaacauucagcuugaagaua

SEQ ID NO: 4201372 - RNA, 65 nt, Human
ugucuuucauuguuauguuuugcugucugcuuugcagauauaugaaauguaauaaagauacagca

SEQ ID NO: 4201373 - RNA, 68 nt, Human
ugucuuugagcuuuggacuggauuugcuucugagguuaagagaaguguguggcagauguugggaggca

SEQ ID NO: 4201374 - RNA, 81 nt, Human
ugucuuuggggaaugcuugaucugugggcucauuccagaacugggggagccauguuuucagcaugauucuaaccauagaca

SEQ ID NO: 4201375 - RNA, 103 nt, Human
ugucuuuuacaagaaaauuuuaucaaugaugcaccauuauaagaguuuguucaucuaccuuauccugagaaaccuagaugcuguauuauucuaacaugagaca

SEQ ID NO: 4201376 - RNA, 78 nt, Human
ugucuuuuagaucacuaaacugaagcaugaaaaggugaaauaguaccuaaggucagauuucaaguuuaucucagagca

SEQ ID NO: 4201377 - RNA, 123 nt, Human
ugugaaagcauucaguaucaucaucaauuuugcaguauucccuagaagcaguuggugcuguucaguuuucuuacuguuacaucauggcuucaugcugcaauuauacaugaacuagguuucaca

SEQ ID NO: 4201378 - RNA, 55 nt, Human
ugugaaaugcuauuuccaugaguagaagaaaaaugaauggaaaagcauuuuuaca

SEQ ID NO: 4201379 - RNA, 76 nt, Human
ugugaagaaaauaugagauguucucuuucgggucauaaggacucacugaaguaguacauguuuauggagcuucgca

SEQ ID NO: 4201380 - RNA, 76 nt, Human
ugugaagccacacguggcauauaaagauguguucaauuucacauugagcaccuauuaugugucaaguauacgcaca

SEQ ID NO: 4201381 - RNA, 58 nt, Human
ugugaagcgugugcaggggacagcagacaucagagcucuccuguaaaucaccuccgca

SEQ ID NO: 4201382 - RNA, 61 nt, Human
ugugaagguuuuuaugggauaucaaguucucucacuuacauuaucucacuggauuuucaua

SEQ ID NO: 4201383 - RNA, 91 nt, Human
ugugaagugcugcccauuaggaguauaagaggcugcucaccuuugggccagucuucauauucauggugucagguagcucuaccucaucaca

SEQ ID NO: 4201384 - RNA, 79 nt, Human
ugauugucauuccuugaugaauuaaagcuagaguugcccaccuguguuucuugcuagaaucauuuggagagauuuauca

SEQ ID NO: 4201385 - RNA, 129 nt, Human
ugauuuaaacaaucuuucuuaaaaaaauucuuucccugccagcauugucauuagaacauuagcaguaauuaaaaccauaaguagaaguucuagaugacugagcagcugagaaagagcaauuaaacauca

SEQ ID NO: 4201386 - RNA, 129 nt, Human
ugauuuaggcagauuugaaagaaauaucaugcagaaggaaagagaagcagcagaaaaauaggcucuucguuccuuucucuucacugucaugaucaugcucauucauuaaaaggaagauucugaagacca

SEQ ID NO: 4201387 - RNA, 68 nt, Human
ugauuuauuuuugacaaauguaucugcauuaugaauuauauuggggauggaauuguuacauuaaauca

SEQ ID NO: 4201388 - RNA, 61 nt, Human
ugauuucaacauuacacaggcaauucaugguuucuuaagaaagccuaugauguuggaacca

SEQ ID NO: 4201389 - RNA, 102 nt, Human
ugauuucaaguuuauuuccuauggacaaugaaauggccuuucacaaugcuuuaugaaauuacaaaucauuucaguuguucccugguugagaaacuuaaauua

SEQ ID NO: 4201390 - RNA, 103 nt, Human
ugauuucaccgcaguuuguuuggauccaggacuuuauuuuaacggagauucaacaaauggaaauccuucuaaaaagucaguacuauguucuaacgaagaauca

SEQ ID NO: 4201391 - RNA, 64 nt, Human
ugauuucauuugaguuuauaguugcugcucauuauguucagcaucugcuuuauuaaaugaauca

SEQ ID NO: 4201392 - RNA, 61 nt, Human
ugauuucugcguucuaagaaccaacccuuggaugguuucugauucuagaggcaggcuuuca

SEQ ID NO: 4201393 - RNA, 74 nt, Human
ugauuugaucuguuuuccuauuguuuguugaugcuuuuauugacagaauuaaugaaaauuacaagguuaaguca

SEQ ID NO: 4201394 - RNA, 64 nt, Human
ugauuugcaaagucguaucugugacggacccacaggagcguccaguugaggcuuuuucagguca

SEQ ID NO: 4201395 - RNA, 64 nt, Human
ugauuugucuaucucaugugcuguuuucugugacggcagaaacucaugaggucagggcaaucca

SEQ ID NO: 4201396 - RNA, 68 nt, Human
ugauuuuggaggcaauuuuagcuuaacuucuaaaucucuagaauuugaagagugccuuccagacauca

SEQ ID NO: 4201397 - RNA, 56 nt, Human
uggggaaaaugcuuguagucagugaucugugcacacugucaugcaaccauucucca

SEQ ID NO: 4201398 - RNA, 56 nt, Human
uggggaagggcacccuggagacugguggaagcccagcagaugcccugaaauccuca

SEQ ID NO: 4201399 - RNA, 64 nt, Human
uggggacacagagguucguugggagauagauggagguuucuccuuacuaccuaugugucuccca

SEQ ID NO: 4201400 - RNA, 98 nt, Human
uggggagaggcccuugagaauggguugcuuuccacagccuagaacucuagcuuuggucagauaccccauucuuacuccugaagaggucagaaucccua

SEQ ID NO: 4201401 - RNA, 91 nt, Human
uggggagaugguaggguaagaugaggagugagcucuggggaaauaggccaggccagagugguacuucuuuuucuucuccucuuuuucccca

SEQ ID NO: 4201402 - RNA, 116 nt, Human
uggggaggccucaggugugguacugccaagagcagguggcaacucugggagagcccucacagaagaugcuggauguugggccuuggcagauaaggguuaacuggagagccucccca

SEQ ID NO: 4201403 - RNA, 70 nt, Human
uggggaggggcucaggggaaguguccagagccgggaacacaggccuggaagccauugcagccacugacca

SEQ ID NO: 4201404 - RNA, 55 nt, Human
uggggaguguuaggccgcuugcuagucaagcugagaggcugccuaaggcucugca

SEQ ID NO: 4201405 - RNA, 130 nt, Human
uggggaucagacagcugcugugugcguuaguuuucaccuugggaagcgggaaaacagagaaagccaugcuucucaaagaagcauaauggcaaaaguaguuuuaugucauuaccuccccccaaauuacuaa

SEQ ID NO: 4201406 - RNA, 77 nt, Human
uggggaucagcaggccaccugccccagucuuggagcucuguagggugaaugaggcagacguggaagaguuggcccca

SEQ ID NO: 4201407 - RNA, 55 nt, Human
uggggaugaaaggaacauugggcagauaauucuuuccuggcccacucuaucccca

SEQ ID NO: 4201408 - RNA, 57 nt, Human
uggggauggggaugggggcacagagggcacuccaccuggcugcuggcccucucucca

SEQ ID NO: 4201409 - RNA, 75 nt, Human
uggggauuaugagagcauccacuucacaaugauugagaggaucaaguaggaugcuuuauaugaaaguacucucua

SEQ ID NO: 4201410 - RNA, 72 nt, Human
uggggauucuuuaaaacauugcagggaaaauauuggagaucagccaacucaaaacaauguuuuagaucucua

SEQ ID NO: 4201411 - RNA, 78 nt, Human
uggggcaccuucaggggucuagggggcuaggggaccugaagccuaggcccaagccagacccugacccuguaccuccca

SEQ ID NO: 4201412 - RNA, 101 nt, Human
uggggcaggagaauugcuugaacccgggaggcggagguugcggugagcugagaucaugccacugcacuccagccuaggugacagagcaagacucugucuca

SEQ ID NO: 4201413 - RNA, 67 nt, Human
uggggcagugagcucuugucccuaggggaaaucucuuuuccuccacgugacaggagccagugcucca

SEQ ID NO: 4201414 - RNA, 114 nt, Human
uggggcugauaacagcacuuacuuuccaggguuguugugaggaaucagugagcuacuaccuucaaagagcuuagugcuuggcacacaauacacucuuugcuguuauuauuacca

SEQ ID NO: 4201415 - RNA, 75 nt, Human
uggggcugcaggcuguggcaggggagccagaaggaagccuaacucuccccugagcauagacucugucccgcccca

SEQ ID NO: 4201416 - RNA, 62 nt, Human
uggggcuggcuauugucucccuccucucuccugucagagggcaaagcaagcugucagccuca

SEQ ID NO: 4201417 - RNA, 76 nt, Human
uggggcuuauuaagaaaauagcuucucaacagauugugaaaaccagcugaaggcuuguuguuuucuuagugucuca

SEQ ID NO: 4201418 - RNA, 100 nt, Human
uggggcuucaggccagagaaggcuggcuccaaaagcaggggcuagauccccuggcuaugccuuuguaacaggggcccaagagccuuugccaccugcucca

SEQ ID NO: 4201419 - RNA, 61 nt, Human
uggggcuuccagguaggccuaaggcagaccacaguuacaugccacaggacuuggugcccua

SEQ ID NO: 4201420 - RNA, 73 nt, Human
uggggcuuguaguugcuagaaccugauggcuccauccuaaagguuuggaacucaauaauucuucuuaguccca

SEQ ID NO: 4201421 - RNA, 74 nt, Human
uggggcuuguuugugucugaguuguuaguuuccaggggacuuagacuguuacagggcacugaacaucucuccca

SEQ ID NO: 4201422 - RNA, 60 nt, Human
ugggggaaagccuucuuguaucgagccagccucuuuggcuggucacuuggggugccccca

SEQ ID NO: 4201423 - RNA, 85 nt, Human
ugggggaacaagaucggcaagccccacaccgucccuugcaaggugacaggccacugcggcucugugcuggucggcuucaucccca

SEQ ID NO: 4201424 - RNA, 81 nt, Human
ugggggagccagacugucuggguucaaaaccuggcucuacaacuugaccagcugugugaccugaggcaguuacucucgcca

SEQ ID NO: 4201425 - RNA, 77 nt, Human
ugggggccuccugcagguggaugauucucuccaacccuccaauguaagaggcucugccgccucagguaggcccucca

SEQ ID NO: 4201426 - RNA, 105 nt, Human
ugggggcucaggauccagcaaggggcggcaggaguaaaggaggaaggaaugacaggugcaaauaccuucccaccaaagcccuuguugcccucuggcuccucccca

SEQ ID NO: 4201427 - RNA, 77 nt, Human
ugggggcugaggugggagguugcuugagccuaggaugucaaggcuucagugagcugagcucacaccacugcacucca

SEQ ID NO: 4201428 - RNA, 61 nt, Human
ugggggcuuuauaggguagaggaucaguucauauaacuuggcuauacccuguggguccuua

SEQ ID NO: 4201429 - RNA, 69 nt, Human
uggggggccgggccaugagggcagugacugugggugggaccggguggccucacagggccaggccccuca

SEQ ID NO: 4201430 - RNA, 96 nt, Human
uggggggguggcacagcccugcccuggaggucuguguggggccgggggacacagccuugcccugagugguaccuguggguaauagggcccccuuca

SEQ ID NO: 4201431 - RNA, 96 nt, Human
uggggguagggcugagcaaggcauagucuuuaaguucugacucagucaauuuuuuaucgagucauuuuuuaaucugaguuuucagcucuaucaaca

SEQ ID NO: 4201432 - RNA, 83 nt, Human
uggggguaucauaggucccuggaaggccaagcuuggcugucccacagccucugggcaggaccaguggacccagugugccucca

SEQ ID NO: 4201433 - RNA, 94 nt, Human
ugggggucagaggucacuguauccagguuccagcuuguucccuggauguaaugcaggcuggcugacagauuuggggugcugacccucuccccca

SEQ ID NO: 4201434 - RNA, 60 nt, Human
uggggguggaggggcgagagacgcucgggagaccuaggcguccggccucucucgcucccg

SEQ ID NO: 4201435 - RNA, 66 nt, Human
ugggguagaaagcccaagucccccucugugugcagcagggggcuuugcacuugagcuugcuucuca

SEQ ID NO: 4201436 - RNA, 62 nt, Human
ugggguagcaaugacacccagcauaacaguugaucgcugugagcugaggucauuaugccuca

SEQ ID NO: 4201437 - RNA, 61 nt, Human
ugggguagcccacaauggggcgguggcccauuguguggcuucugcuucuggggcuucucca

SEQ ID NO: 4201438 - RNA, 75 nt, Human
ugggguaugcagcuauauugguaauauuugcucaguuuauucauacugaucgcaugcauaauauagauugcccua

SEQ ID NO: 4201439 - RNA, 80 nt, Human
uggggucacuuaagcaagccagugacagccagggaaggaucugacuacuccccaacuucaggcugcuaugagaaucccca

SEQ ID NO: 4201440 - RNA, 130 nt, Human
uggggucuugucuugucacccaagcuggucuuaaacuucugagcucaagcgauccucccacuuggaccuagccaggugcugggauuauggguauuagaguuuaaauuucuuugcucaacaccacucccca

SEQ ID NO: 4201441 - RNA, 59 nt, Human
uggggugaagggaagcguaaaaugcgaccaaggaauuacaugcuauaauuucacccuca

SEQ ID NO: 4201442 - RNA, 77 nt, Human
uggggugaggaugugugauaacagggcaugacgggcagguagaacugcucgcuuguguuuuacacacaggcgcccca

SEQ ID NO: 4201443 - RNA, 57 nt, Human
uggggugcggggccaggaaggaauucuucuuuaaaccuucuugaauacccaacccca

SEQ ID NO: 4201444 - RNA, 58 nt, Human
uggggugggcugaccucauaccugccacauacugggagcccagaguccucccacucca

SEQ ID NO: 4201445 - RNA, 98 nt, Human
ugggguucaaggucaacauguaaaccauugugagcaucagugcaaugcugcacaagauggucaccaguguucuuugcagaaugacaaaucaagcccua

SEQ ID NO: 4201446 - RNA, 68 nt, Human
ugggguugaagaaaggaucuaggaaucugcauaucagacuuugaaccaaucuuccuguuucagcccca

SEQ ID NO: 4201447 - RNA, 81 nt, Human
ugggguugggcucagccaguagaucgggaggauguaggauauugugccaacauagcuucaaucuauuggcuagcaacucua

SEQ ID NO: 4201448 - RNA, 60 nt, Human
uggguaaaaaacugaaguaaguggcaacuagugaaagagccauggcuucuauuuuacuca

SEQ ID NO: 4201449 - RNA, 65 nt, Human
uggguaagguacuguagaucuguaccagccuucaugugaauagcaccucacagugcucuugccua

SEQ ID NO: 4201450 - RNA, 67 nt, Human
uggguacauuugcuucugcuaaacaacuucucauuugauagggcgugggcauaaguaaauagauuca

SEQ ID NO: 4201451 - RNA, 56 nt, Human
uggguacuccuauuaguucagugguucucaaacuugagcugcaucggaaucaccca

SEQ ID NO: 4201452 - RNA, 56 nt, Human
uggguaggaaucgaguguauggcucagacgccauagacuguuacuguucuuacuca

SEQ ID NO: 4201453 - RNA, 68 nt, Human
uggguagggccucaaucacguguuccauguucugcagcuuggugcggauggacgugaugccuuagcca

SEQ ID NO: 4201454 - RNA, 66 nt, Human
uggguagguguggccugaauguugucaguuacccacuucuauaaauaucccagucacaucuaccca

SEQ ID NO: 4201455 - RNA, 57 nt, Human
uggguaugugaggccuuccauauuuuaugagauacaauacugaaccucauaagccca

SEQ ID NO: 4201456 - RNA, 55 nt, Human
uggguauuaggaggaacacaggccucggcugcugagggucugcuuucuaauccca

SEQ ID NO: 4201457 - RNA, 56 nt, Human
uguguuuagagagcacauucagugaguuuucugucugaacauucuuucugaacaua

SEQ ID NO: 4201458 - RNA, 58 nt, Human
uguguuucucugaggggucccuuuaaaggaaugcccuuaaucccccucaggaaguaca

SEQ ID NO: 4201459 - RNA, 84 nt, Human
uguguuucugggccuguguuaguuaugggucucuuguuauaagaagcagagacuccugccaguuaacauaagcaaagaaggaca

SEQ ID NO: 4201460 - RNA, 108 nt, Human
uguguuucuuuuacccagaagaggaaguggagaauaauuucauaguugguguuagccaaaaauuacuuuacacuuucaucuucaauuaaauaugguauuacaaacaca

SEQ ID NO: 4201461 - RNA, 84 nt, Human
uguguuugccaggauucuccacuguaagguuauuauuauuuuuuguuauuaauauuuuauagggagauauuuugguaguaugua

SEQ ID NO: 4201462 - RNA, 65 nt, Human
ugugaggcugguucugaaguacuguacaccccagcagaggugacagccacaguaccagcccucca

SEQ ID NO: 4201463 - RNA, 76 nt, Human
ugugagguccugguggagucucuggggaagugaaagaagcuccuuuaacuugacuccacucacaggacaaagugca

SEQ ID NO: 4201464 - RNA, 56 nt, Human
ugugaguaugcaguguguauacuggaaaauugccaguguuucaccguauguucuca

SEQ ID NO: 4201465 - RNA, 66 nt, Human
ugugagucuaggucaggguguuucaacaugcaaaagcagacccugagcccuugucuguggcucacg

SEQ ID NO: 4201466 - RNA, 68 nt, Human
ugugagugucguguuguacugacauguagcccucagaggcugacauuucagcgugcaugacauguaua

SEQ ID NO: 4201467 - RNA, 64 nt, Human
ugugagugugucugcuuuggcaauaaguggggugauacucacuuuuucaugcaaacgcuucaua

SEQ ID NO: 4201468 - RNA, 75 nt, Human
ugugauaaagcguguugcuagacauggucaagaguuaacuugaaauguucauauuuaguucacgcucaaugcaua

SEQ ID NO: 4201469 - RNA, 75 nt, Human
ugugauaauugcuaauccugccuucuaugucaggucggacagaugugcggggcagcacaguaauuuucaacuuca

SEQ ID NO: 4201470 - RNA, 76 nt, Human
ugugauagacuuaagaauauugaaguuguggagccuaaaaguuaccagcacucuauugaauauucucucucuuaca

SEQ ID NO: 4201471 - RNA, 58 nt, Human
ugugauagaggaaauguugggaggugguguaucugccaccucuguguccugugucaua

SEQ ID NO: 4201472 - RNA, 83 nt, Human
ugugauauuuaaaugcaggucuguuuucaaggucaguuuccggaaacagugacccugagaaggcuuccuccugaguaugcaua

SEQ ID NO: 4201473 - RNA, 66 nt, Human
ugugaucaguguggguaagcaugcugucaaagaugauaucgucacguuuacucaugagacuguaca

SEQ ID NO: 4201474 - RNA, 72 nt, Human
ugugaugggauccagauguggcuccaucccacgaaggcaagugaugaaagcaguaaaugggucccaugcaca

SEQ ID NO: 4201475 - RNA, 73 nt, Human
ugugauuaagggcaugggccuuaagauggaaaagauuauuuugaauuauucacaugggcucauucuaaucaca

SEQ ID NO: 4201476 - RNA, 61 nt, Human
ugugauuagauugagucaaccuugauaauccccccaucucaagaucuuuaguuuaaucaca

SEQ ID NO: 4201477 - RNA, 103 nt, Human
ugugauuuuucuuacgcugcguugaaugcaaggaauuuguuuguuuauuuucauucauuuccuauggauacaggcagauguguaaguugagcuuuaacucaca

SEQ ID NO: 4201478 - RNA, 109 nt, Human
ugugcaaagugauuccugggguuguagcugugugauucccauuauaguccaugaggaucacugacuuuaucaggaaucacacagcuaaacccucauguaacacuucaca

SEQ ID NO: 4201479 - RNA, 68 nt, Human
ugugcaaccugauggcaaguauuuguuuuagaagucauucuaaaaucauucuggugucaguaugagca

SEQ ID NO: 4201480 - RNA, 83 nt, Human
ugugcaaggauaaauaagacagcugucuuucuguuuacaaaggaucuuucaaugguucuagguuagaaggacagauuggcaca

SEQ ID NO: 4201481 - RNA, 72 nt, Human
ugugcaaucaagaggcuaugaggagugagguuuccucuuggauuggccuucuaauuagucuaggaugacaua

SEQ ID NO: 4201482 - RNA, 83 nt, Human
ugugcaauuuacuggguuuccugucuuucucucacacuagaaaguaaucuuucugaguugaggaaaugcauuugccuugcaca

SEQ ID NO: 4201483 - RNA, 63 nt, Human
ugugcacuggcuggacucugaccucuuuugccuguugaaagacaucaccccagccauugucca

SEQ ID NO: 4201484 - RNA, 62 nt, Human
ugugcagcuaucucucuacaguuguacauaaaauguuuuuacuguaaaaugagauauguaua

SEQ ID NO: 4201485 - RNA, 74 nt, Human
ugugcaguaguuaucaucauacuccagaccaauacuucucaucugugucuggguuauuaugauggcuaccaaua

SEQ ID NO: 4201486 - RNA, 80 nt, Human
ugugcagugcuaggcucugcaggacacuuuguugggggugaaauuucaagcagggauacugcagggagggaucugcuaca

SEQ ID NO: 4201487 - RNA, 82 nt, Human
ugugcagugugggcguggcagucaggaaaaggugagaaggagacucacauucacuggauguuacuacccaccagccagcaca

SEQ ID NO: 4201488 - RNA, 80 nt, Human
ugugcauauugcaaaaccauccuaaguaaacagucugugucaucuguauuaaagggaaguuaugcauggauuaguguaua

SEQ ID NO: 4201489 - RNA, 69 nt, Human
ugugcaucuuugugaugaggccuaagacauugucuagcgguauuucuuaacuucucaugcacaugcaca

SEQ ID NO: 4201490 - RNA, 69 nt, Human
ugugcauuagccugugugcugaugacgacagaggcuggagagcuucuguuguacccagguggaugcaca

SEQ ID NO: 4201491 - RNA, 55 nt, Human
ugugcauuugagagauauccaggcacagucccccugggugauucuuauuuguaca

SEQ ID NO: 4201492 - RNA, 80 nt, Human
ugugccaaucuccuaguuuugaucauuguauuauuguuauguaagauauugucauugaggaaaacuaggugaaggacaca

SEQ ID NO: 4201493 - RNA, 125 nt, Human
ugugccaggcgcaugcaaaacuuaucccacuugauccuuacaaaucugugagcuagccaucauuauccccucuuacagaugaggaaacagggucagagggguaaaaugcuaugcccaaagguaca

SEQ ID NO: 4201494 - RNA, 62 nt, Human
ugugcccucagaagaguacaucagccaaaccaagagcuaagacuugcagcuuaugagggcca

SEQ ID NO: 4201495 - RNA, 56 nt, Human
ugugccuggagucccugaggagucagugccccugcuuacauggagcccaggccaca

SEQ ID NO: 4201496 - RNA, 65 nt, Human
ugugccuggccccugguguguuuuaaagcucaaguuucaugccaccccauagguguuaggugaca

SEQ ID NO: 4201497 - RNA, 58 nt, Human
ugugccuguucccacuuugccuucuaccacgauuguaaagcuuccugggccaggcgca

SEQ ID NO: 4201498 - RNA, 106 nt, Human
ugugccuuaguuuuuccaucuguaaaauguuguuaguuuuggcauuuaccucauaggguuggugugagaagggaauguaaagcaaauggaaauaguagcuggcaua

SEQ ID NO: 4201499 - RNA, 82 nt, Human
ugugcgaagucugugaucauucuugauuuaagucggcagaguucgauuugauaaacacuaacugaacacucacugugcaaca

SEQ ID NO: 4201500 - RNA, 88 nt, Human
ugugcuaauuacugguaauaagaucuguuacaugggccuuuacauagguuaugcaaagaaauagacuaaugaaaugaguaauagcaca

SEQ ID NO: 4201501 - RNA, 75 nt, Human
ugugcuccuggcucucugagggcuggagcuguucuauuuccauuugcuucugccccaccucugccaggaugccca

SEQ ID NO: 4201502 - RNA, 69 nt, Human
ugugcucuuagaacauacuuagugugauuucaguucuuuuaaacauacugagauuuguuuuauggucca

SEQ ID NO: 4201503 - RNA, 59 nt, Human
ugugcugcagccaugcuuccgagaugagaauggucacaggaaggcaaugguuuggcaca

SEQ ID NO: 4201504 - RNA, 63 nt, Human
ugugcugcuagacugcuaauggauguuuauuauuauuuaaauguuuuaugucucuagcugcca

SEQ ID NO: 4201505 - RNA, 55 nt, Human
ugugcugcugugaauaagaccuauuuaaguagguuacuuuaucucaugcaccaca

SEQ ID NO: 4201506 - RNA, 66 nt, Human
ugugcuuaugcacacauaugagcaugugugugcccaugcauguguaagugugugugugucugugua

SEQ ID NO: 4201507 - RNA, 68 nt, Human
ugugcuuaugugggagggagagguggugugugucuguucucauaccucuuucugcagccgcaggcaua

SEQ ID NO: 4201508 - RNA, 78 nt, Human
ugugcuuccaaugggcuggcagccugaacagcaucagcaucaugcuguacauucugcacaggcccagcugugggcgca

SEQ ID NO: 4201509 - RNA, 82 nt, Human
ugugcuuuacuuaucuucuauuuccaaucgcaacuagcaccuuuguaguagguguuugcugaagugaagguauguuugcaua

SEQ ID NO: 4201510 - RNA, 60 nt, Human
uguggaaaagaauaagggagauuauuuuaaucuaaguggccucacuuaccuuuuucuaua

SEQ ID NO: 4201511 - RNA, 97 nt, Human
uguggaaaugcaugaguuuggagaguuaauuuuuaguuggauauuacaugugagcaugucccaagauacagcuagagaaacuaccaccauguucaca

SEQ ID NO: 4201512 - RNA, 68 nt, Human
uguggaccagagggaugacauuuggcaccaagaaaguaacccaggugucugucucuuuuucaguccca

SEQ ID NO: 4201513 - RNA, 116 nt, Human
uguggaccucuagaccagccccuucauugacuuaaaggcucugguuacagaaaaggaaaagcugugaccacgacaucuugugaguuaugagaagugucugcauguaugaggccaua

SEQ ID NO: 4201514 - RNA, 70 nt, Human
uguggacgugaccuuauuuggaaauaggguuuuugcagacguaaucaacuuaagaugaggucaugcuaua

SEQ ID NO: 4201515 - RNA, 107 nt, Human
uguggacucccugcugggauggcauccugggccuugcaaagagaaaucuaauaaaauuggugucaggggcucccugggugccaguuccccugcugccugaccccaca

SEQ ID NO: 4201516 - RNA, 69 nt, Human
uguggacuuuguaauagaauuuaagguuaaguaaaguuucugcuuuccuuaggcuguuugcagugccca

SEQ ID NO: 4201517 - RNA, 56 nt, Human
uguggagaaggaacagcgagggaacaccagcccucuacagccuuccuuccuccaca

SEQ ID NO: 4201518 - RNA, 83 nt, Human
uguggagacuuagcucauagaaguugaacuaaaaauauuuuaagaaggaaauaaacugccgauuuuuguugagagauucuaca

SEQ ID NO: 4201519 - RNA, 77 nt, Human
uguggagcuccccaacucagccgaggcuucagcuauaguuggagaagaggccuggccccaguugcuaggagcuccca

SEQ ID NO: 4201520 - RNA, 63 nt, Human
uguggagcucuacagauaucaugugguuuucugcaaaaguuuugaugucuguugaauuucaua

SEQ ID NO: 4201521 - RNA, 59 nt, Human
uguggaggauucugaugccagcucagggacacagaggcuggucagaaugccucccuaca

SEQ ID NO: 4201522 - RNA, 70 nt, Human
uguggagggccuacagaaaugcuuacaagacuugucaugacuuaagcuguucuuuagauauuuuuccaca

SEQ ID NO: 4201523 - RNA, 92 nt, Human
uguggauacccuuccccacacauuuuagagcuccaaguacagcacagugauggcauuucaugcuccuuggaaccugugaggugggugccaca

SEQ ID NO: 4201524 - RNA, 92 nt, Human
uguggauuaaauagaauauaugauuaaaguugauuucaucuauuucuuuuaacuuuaaaaaauaugucuguuagaggauuugaaauuccaca

SEQ ID NO: 4201525 - RNA, 66 nt, Human
uguggauucacuagguugcaaaacuguggacauagcacagacuuguucccuagugagugaaaaaca

SEQ ID NO: 4201526 - RNA, 76 nt, Human
uguggcaaaauugcacaauauagacaugacugcuuauauuuuguugucuuuauuuuaugcuugugcaaaucccaca

SEQ ID NO: 4201527 - RNA, 77 nt, Human
uguggcacuuucagcaggcagacagaauacaaauuaacuugaagcagucggucugcuucugagagcuucuagccaca

SEQ ID NO: 4201528 - RNA, 55 nt, Human
uguggcagaacugggacucaaacuuggagugccuuggguuucauuuucuagccca

SEQ ID NO: 4201529 - RNA, 75 nt, Human
uguggcagcagccugggcagccucacacaauguuuguagacagcaauggacugagagcugccugcaucugccuca

SEQ ID NO: 4201530 - RNA, 63 nt, Human
uguggcauaguaggcugucaaaaaugguagcugcuguuauuaugaugaucaccuauuagccca

SEQ ID NO: 4201531 - RNA, 72 nt, Human
uguggccuuucagcaguuauuccccuacagaugacaaacuccagguuugagggaacagauugcuuggcuacg

SEQ ID NO: 4201532 - RNA, 98 nt, Human
uuaacucccauucauuuccucaaauauuuacuuacugaguguguuuuaaccaccaggcucugaguuagguguuagagagacaagauaaaugagauuag

SEQ ID NO: 4201533 - RNA, 122 nt, Human
uuaacuguagccaucaccacaucacccacaccagcagcggagagucuguucagccaucccuugauucccuucacugagaaaauacacagauuuuucagcuccuguguugucagcacaguuga

SEQ ID NO: 4201534 - RNA, 63 nt, Human
uuaagaaacauuuuuaugacaguuuagcuuuuucagcugcuuucauuauguuguguuuuuuag

SEQ ID NO: 4201535 - RNA, 63 nt, Human
uuaagacaguguauuuguuuucuauggcugcuauaacaaguuaccacaaauguagugucuuaa

SEQ ID NO: 4201536 - RNA, 76 nt, Human
uuaagagaagcacagugaagcauaaggagauugacuuugaaaucggacagucuugcauucacagucuggcucuuga

SEQ ID NO: 4201537 - RNA, 92 nt, Human
uuaagaguucucauugcugugcucacagaacaauguuuaguucuaacuguaguugggcugacaaccaucugacaagcuaggaggauuuuuaa

SEQ ID NO: 4201538 - RNA, 101 nt, Human
uuaagauaggauaauuagaaaaagaauguuaguuucugauacaguaaauuugaggcuguuaauaaggauucacauuuucuuggcaaauuaucuacuuuuaa

SEQ ID NO: 4201539 - RNA, 58 nt, Human
uuaagcaaaugucaguuguuagucaaccaaaaucggaggcaacagauauuuugcuuag

SEQ ID NO: 4201540 - RNA, 96 nt, Human
uuaagcagaagcaauuguaagcuuuaagcacuagcaaaugugaagacgcuuuacaauuugcugugugcuuuagagacucguauugaccauguuuga

SEQ ID NO: 4201541 - RNA, 89 nt, Human
uuaagcauauuauguagaugcacuugcguguuugcaaaucucuucccaacgagggauuugauucuucaagugccugauaagauguuuga

SEQ ID NO: 4201542 - RNA, 82 nt, Human
uuaagccagacuauuaauaucagucagaggauauucagauuaaucaguuuuaguucugcuguaauaucucugcugggcuuga

SEQ ID NO: 4201543 - RNA, 67 nt, Human
uuaagcguuuugagaagcccugcgggaaagaaaacucuuuauuccaguguuucucaaauugauuuga

SEQ ID NO: 4201544 - RNA, 72 nt, Human
uuaagcuuaacuugucagaaaauacaguguccagugacaaacuguagaaauguuuuugacaaauuaauuuga

SEQ ID NO: 4201545 - RNA, 129 nt, Human
uuaaggaaaaugucuucauugcaaaaaggguagugauuauuuuuaguauaggaugacauuuuggaguucauuggaaaucuuucuauuucuaaaaacuacuuuuuuucauugaaaauacuaacccuacga

SEQ ID NO: 4201546 - RNA, 83 nt, Human
uuaaggaaagcaaaugccugggcuccauccucagagagucucauucacugggucaggauagagcccaggaaucuuuaccuuaa

SEQ ID NO: 4201547 - RNA, 66 nt, Human
uuaaggaccaguuucaaacuguaccaaauccucacucacuggcugaugcaguaaauuggucucuaa

SEQ ID NO: 4201548 - RNA, 60 nt, Human
uuaaggcauugauauggugcuaagggaaaaauguauuagcacacuuguacaaugcccuag

SEQ ID NO: 4201549 - RNA, 58 nt, Human
uuaagguauagcuugcauacagaaaaguuaacucuuuucaguguauagcuaauuuuga

SEQ ID NO: 4201550 - RNA, 77 nt, Human
ugccucaguuucaucugcagaaaaacauagagauauuuacuugcucuaauaaauuauugugagguugaaaugaggua

SEQ ID NO: 4201551 - RNA, 67 nt, Human
ugccuccucaggcugccuggaagacucuacacagauauggagaauccuugacucaggcugaggggca

SEQ ID NO: 4201552 - RNA, 61 nt, Human
ugccucuaggagaaagcauaacauuuuagauaauccauuuaaaaugcuucugauagaagca

SEQ ID NO: 4201553 - RNA, 61 nt, Human
ugccucugccagcuucuggugguugccggaaacccuuggcauuccccagcuuguagacgca

SEQ ID NO: 4201554 - RNA, 56 nt, Human
ugccucugcugcauauucaccuggaaaucauccacaugccaagcaccgcagaggca

SEQ ID NO: 4201555 - RNA, 75 nt, Human
ugccucuuccuguccucaccuuggcaggggggaggcuggucccaccuaggcugaguguggacccaggaaguagca

SEQ ID NO: 4201556 - RNA, 64 nt, Human
ugccugacugcugccaccacuaacaaaucaaugggccccuaggguuggagguggugcaggggca

SEQ ID NO: 4201557 - RNA, 76 nt, Human
ugccuggagcugggggcuccucauggggccaugcaaagcgcccuguguggaaggcaggaggcccaagucccaggca

SEQ ID NO: 4201558 - RNA, 65 nt, Human
ugccuggauacucauuaauuuccuauauuuuuaucugccuugaauuauuuucuguguccagugca

SEQ ID NO: 4201559 - RNA, 57 nt, Human
ugccuggcaaugccagaagccaggacuaaucagaccaggcuuccuucuguccgggca

SEQ ID NO: 4201560 - RNA, 59 nt, Human
ugccuggcacauagcaaccccucccucaauaaaggguagcuguuaauauaugccaggua

SEQ ID NO: 4201561 - RNA, 57 nt, Human
ugccuggcccagggcuccgcagggguggauccagcccugggucaccaggcccaggca

SEQ ID NO: 4201562 - RNA, 72 nt, Human
ugccuggccugaagugcagagaguuggucuguuuaacaaagcaggcacgcucccugcgcgaugguccuggca

SEQ ID NO: 4201563 - RNA, 57 nt, Human
ugccuggguccaggccaagccucucaucuccuccaagcaggccaucugccccaggca

SEQ ID NO: 4201564 - RNA, 58 nt, Human
ugccugucuuaauaucuggaaagagauuucuguguccuguccagcagcaaggcaggca

SEQ ID NO: 4201565 - RNA, 56 nt, Human
ugccugucuucaggagugucacagagggccuuguggacauggcugaaaggcuggca

SEQ ID NO: 4201566 - RNA, 66 nt, Human
ugccuuaaaaaugugacagaugcaguacagucauuguagauugccuccagaugaucauauuuugca

SEQ ID NO: 4201567 - RNA, 60 nt, Human
ugccuuagagcacucaagagugagaaaaauucuaaagcauucauucuugggguaaaggua

SEQ ID NO: 4201568 - RNA, 77 nt, Human
ugccuuagggaaggacagugaagaaagauggcuuauagcaaggccucacccuuucuucuacuguucuaaccugugca

SEQ ID NO: 4201569 - RNA, 107 nt, Human
ugccuucuccaaucagugguguggggaaggaacugccauugguucuggaaaauccagucacaugauggggcuggacaugaccuccuucccuuagcaugaagagggua

SEQ ID NO: 4201570 - RNA, 130 nt, Human
ugccuucucuuucuuggccggcugcgucauucacauggcauuugucaagauaaguaccuuguagcuggguauuuagaaugcguguacguguguuguguguguaugugguggagaugaagaaagguuaggg

SEQ ID NO: 4201571 - RNA, 130 nt, Human
ugccuucuggguaagaaaggugauucuuucuuucugugacuuuuuaaaucuucggcuuauucaguuucuaaggugccuaguguuuggaagucauagccuuuggaaucacucauugucuacaggugggaca

SEQ ID NO: 4201572 - RNA, 57 nt, Human
ugccuugagagaaugacucgggagcccucagacucaacggacuuucuucucagggca

SEQ ID NO: 4201573 - RNA, 90 nt, Human
ugccuugcaagggucaucccucacucuguuugugaaacccauagcugcauggcacaggcgguaaggguguggugagaccuuaccagggca

SEQ ID NO: 4201574 - RNA, 55 nt, Human
ugccuuuacugauuagcugugucugccaugggcucagaaagagaaagcagaggca

SEQ ID NO: 4201575 - RNA, 55 nt, Human
ugccuuuccucagggugagugguaggaaaucugguucaggcaguggggaaaggca

SEQ ID NO: 4201576 - RNA, 66 nt, Human
ugccuuugccauauucuguuggguagaaauaaguuauaaguucugcccacacucauggggaaggua

SEQ ID NO: 4201577 - RNA, 63 nt, Human
ugccuuuuacucuaagugaaaugggaagacuuugauaaacauugagcaaaggaguaaaaugca

SEQ ID NO: 4201578 - RNA, 68 nt, Human
ugccuuuucuguagcucuggaauucccaucuguauacauggaaccucuugagugugcagcguaaggca

SEQ ID NO: 4201579 - RNA, 55 nt, Human
ugccuuuuuggagagaugcuauuuacucugauagcugaaagcuugcaacgaggca

SEQ ID NO: 4201580 - RNA, 57 nt, Human
ugcgaugaggccaggacccuccuaaacccuaacagcauccuaacgaggcccauugca

SEQ ID NO: 4201581 - RNA, 90 nt, Human
ugcgauguggcucuggauuauguucgacuuuagaaauagugccagaacuauucuuugauuuguggacauggacccugagacugcagagca

SEQ ID NO: 4201582 - RNA, 97 nt, Human
ugcgcaggcgccgggcgagaggcugcgccugcccuacccuggagcgcgcgugcgcgcgagagccggaaggggcggugccuggcgcggcgccugcgca

SEQ ID NO: 4201583 - RNA, 64 nt, Human
ugcgcauucugagggugggaagggcuaaauauuuacauugcaagaucagaacucagaaugugua

SEQ ID NO: 4201584 - RNA, 59 nt, Human
ugcgcuggcagacacucaaaagcugggagaauauuuucugucaggaaggucuaagugca

SEQ ID NO: 4201585 - RNA, 75 nt, Human
ugcgcuuuaaaagcugcccuguguuagaguucauuuuacagauguacuccuggcaggcagccuguuucggugaca

SEQ ID NO: 4201586 - RNA, 60 nt, Human
ugcggaggggugagccucccauccagcaccaaagcgggcucugagggcuuaucccuccca

SEQ ID NO: 4201587 - RNA, 124 nt, Human
ugcggccacugugagagcacaaggccacccucagccugcagggcugccuguuguggaggcugcauccccagcgccugcagcguugcagagccccaggaaggccccuugaccucucccugcugca

SEQ ID NO: 4201588 - RNA, 79 nt, Human
ugcggccagaagguuccacggccuaccagcgagcccuggcucguccaggaagaucggccgauggugccgagcuggccca

SEQ ID NO: 4201589 - RNA, 62 nt, Human
ugcggcggcgggcagaggacuaccacaaaugcaaaguaaggagcuuccuccccgcaguugca

SEQ ID NO: 4201590 - RNA, 60 nt, Human
ugcggcucagacuucccaagaacaggccaucuucugugggaugggagcucuggagcaacg

SEQ ID NO: 4201591 - RNA, 85 nt, Human
ugcgggaggcccucacacugucuccucuaccugcuucucucuugcucugaagaugccuguagcaggaagaugugagcuucccaca

SEQ ID NO: 4201592 - RNA, 72 nt, Human
ugcgguaaguaggaagcauaaaagucagcuguggaacuugacuuuacagauauguuuccugagcucauugua

SEQ ID NO: 4201593 - RNA, 69 nt, Human
ugcggugggugcgggaggcgcgccuaggugccgaaacccggucugugcugccauccuguggccauugca

SEQ ID NO: 4201594 - RNA, 61 nt, Human
ugcgucugucuucuuccccuuccuggcaauaauaggguguguacaagacaagacaaaugca

SEQ ID NO: 4201595 - RNA, 67 nt, Human
ugcguggcgcagcgugugggaugaaugugcaccguaagagguccagucccacugcggugcccuagca

SEQ ID NO: 4201596 - RNA, 89 nt, Human
ugcuaaaauuuaggacaucaugucacuaacugcuacugauauauuuauugcuuaaucauuagcgcuugggacacauggagugcuuagca

SEQ ID NO: 4201597 - RNA, 85 nt, Human
ugcuaaacacugcuagauugcaagaaauaaucgaauagacuaauuuauucuaguuuaagguuagaucuuuccagggguguuugca

SEQ ID NO: 4201598 - RNA, 92 nt, Human
ugcuaaacuguaguggcacaaauccaagaaucaaagaaguauccuaagccugugguucuuugggauuguagcugucugugguuuuuacagua

SEQ ID NO: 4201599 - RNA, 68 nt, Human
ugcuaacucuccuaaaggacuaucuacagggaccuuuccuauagaaaauccaguguggggagaaggua

SEQ ID NO: 4201600 - RNA, 76 nt, Human
ugcuaaggaagcuacaguuuacccaugguugcagaaaguaaauaugugaguagaugugcaauuuauauucuuagua

SEQ ID NO: 4201601 - RNA, 118 nt, Human
ugcuaaguauucuggaguugcuucugguuuacucugcacugcucaccuccgagggccagauccacaccccugugacagaugcggaaacucagagaagccacccagcuagugaacagca

SEQ ID NO: 4201602 - RNA, 88 nt, Human
ugcuaaucaaauaaagaaaucagguugaaaacuaguggauaccuugcuggguccaguaaauuacuugaugucauuaucuuuugaagua

SEQ ID NO: 4201603 - RNA, 65 nt, Human
ugcuaauggggcuagacaaccagugcccuugagucugaagggagccaguuuguuagcccccugua

SEQ ID NO: 4201604 - RNA, 60 nt, Human
ugcuaauugugccuuaaacugcauaauuuauauaaccauguagaguacagcacaacagca

SEQ ID NO: 4201605 - RNA, 63 nt, Human
ugcuacagagccaggaagagugguaugaagugacauuaagaaccauuuuucuuccucugugca

SEQ ID NO: 4201606 - RNA, 63 nt, Human
uguuuacuuaugugggucacaugguccugcugaccauggaaagagaagacugauaagugaaca

SEQ ID NO: 4201607 - RNA, 61 nt, Human
uguuuacuugagguggaaacaauucucucaucuauguguuguuuauucucuucagugaaca

SEQ ID NO: 4201608 - RNA, 69 nt, Human
uguuuaggaggcuuucccaaguuuuaccaaaaaaggcugguaguuucuggguuggcuucuaccaaaaca

SEQ ID NO: 4201609 - RNA, 126 nt, Human
uguuuaggcugcuuauuuuuucaguuucauaagcuaaguggaagucuuaucaugcccacaauauuuucugggcccugguaacauucccacauaguuuauacuuggauaaaauauuaaaaccaaaua

SEQ ID NO: 4201610 - RNA, 98 nt, Human
uguuuauagaaacgauagcauugcaguuggugucacugauugcccacguuguuacuucaaugaagccagcugggaugcgauugcauggucuuuaaaua

SEQ ID NO: 4201611 - RNA, 75 nt, Human
uguuuaucuuuuaugcuacucaauagucagugccuagcaaagugauuggcucuuaguaaguaucuaugauggaua

SEQ ID NO: 4201612 - RNA, 55 nt, Human
uguuuauuuucaggauggauugaggcuuuuccugcagucucugauauaauaggca

SEQ ID NO: 4201613 - RNA, 85 nt, Human
uguuucacuaaugaguuaauguguugcccuuuauucuguggccuauuucuucucccaguaacaauugacacuucauugugaggca

SEQ ID NO: 4201614 - RNA, 118 nt, Human
uguuucaggacuaaagaguuggcuacaguacaagcaaugcauuuuugaacauugauuugccagaaguguaucuguugucuguugcuccaggcuggcauuuuuaauuauuucugggaca

SEQ ID NO: 4201615 - RNA, 96 nt, Human
uguauacauauuucuuauucuuguuacauacaaauagagcuguaguaucaaauaauuagugaucacuauauagcuauguguauguauguguauaua

SEQ ID NO: 4201616 - RNA, 81 nt, Human
uguauaggaguguagggcuuuuauguuugcaaaaugcuuucacaugcauuaguuaacauauuuggcugauauucccagaca

SEQ ID NO: 4201617 - RNA, 58 nt, Human
uguauaguguggaaagaacaguuggucaggcaaagguuuuuucagccacaccuguuca

SEQ ID NO: 4201618 - RNA, 61 nt, Human
uguauauaagguaaagcgauuguuaacgcguaugugucuauaugugcguuaccuguauaua

SEQ ID NO: 4201619 - RNA, 68 nt, Human
uguauauacacacucccauguucuggguaugugcacacauguccucaugugcugaguguguauauaca

SEQ ID NO: 4201620 - RNA, 102 nt, Human
uguauauagaauacacagggaaaguuugagaagugaaggacugaccccuccaacugccguucugucuauuuuauacucaaaucuucuauauauuaucauaca

SEQ ID NO: 4201621 - RNA, 103 nt, Human
uguauauaugauauauauauauaugcacauacauaugcucuauaaauauaagcucuguguguguguguguguguguguguguguauauuuauacauguauaca

SEQ ID NO: 4201622 - RNA, 129 nt, Human
uguauaugugguuuaugugugugcacacguacaugcauauaugcauauauguguguauaugucuauauguacauacauauguguguauaugcauguacgugugcacaaauguacauacauauauguaca

SEQ ID NO: 4201623 - RNA, 74 nt, Human
uguauauguuuucaacuucauugacuuugcugccuuuccuucucagaggcugagcugguagugaguacuauaua

SEQ ID NO: 4201624 - RNA, 113 nt, Human
uguaucaagacagaaaaugaacuggauaagaguuuuacuuccuagaccuucuggucugaaaugcagggagagaacucugucuuuaugccaguuuauuuaacuuaaaugaaaca

SEQ ID NO: 4201625 - RNA, 83 nt, Human
uguaucccauuaaccuugaccaggcccagaccacaucccaggagcugguuucuggguuugucuaggaccacuagugggaccca

SEQ ID NO: 4201626 - RNA, 82 nt, Human
uguaucccuuaaguaagauuuuuuuccacagacucagacucaaggcugggucagaaucagagaguugcucuuacagggugcg

SEQ ID NO: 4201627 - RNA, 68 nt, Human
uguaucuguaaucccagaucaauacugaaaaugcuuucagggucauucuugggcaugcacagacugca

SEQ ID NO: 4201628 - RNA, 77 nt, Human
uguaucuuauugcuguugccagauaacuuugcuuuuucuuugagucuccaugucuuacaugcaguuuaugagagaca

SEQ ID NO: 4201629 - RNA, 64 nt, Human
uguaucuuucauuggcagagccuguuuuguuuuaaaaucuguucugcagugaauuuaauuuaca

SEQ ID NO: 4201630 - RNA, 94 nt, Human
uguaugcucaugagcuaaugauugaaauaccuguaucugugauaacagcguaauagauacaacuguuuaaacauuaaguccucgugaaaauaga

SEQ ID NO: 4201631 - RNA, 74 nt, Human
uguaugguguuuauuuuucccagaaccagaacauaguagauugucaauaauuuugaagaagugaauaucauaua

SEQ ID NO: 4201632 - RNA, 78 nt, Human
uguaugugugguuuaagaauugaauucuggaaagauaccggaauugcauaaacacauuucuuaugaccugcguauaca

SEQ ID NO: 4201633 - RNA, 56 nt, Human
uguauguguuuuauguguguuuaaauaaauauguuagauacacguguauacauaca

SEQ ID NO: 4201634 - RNA, 84 nt, Human
uguauuaaguuguaguuucuacaagggaagggaucuuaucuguuuaacuugaucaguagagcauucacugcagcauaaugugca

SEQ ID NO: 4201635 - RNA, 58 nt, Human
uguauuaucuaguaacugauaguggcuaauuccugccaugaaguaaauagaaaauaua

SEQ ID NO: 4201636 - RNA, 102 nt, Human
uguauugaauuuagguuucuuugauuuauugcaagagcuguaagguaaccaaaaauguuuaaauuaacagcucugcauuuuggguuaaaaccaaaagaugca

SEQ ID NO: 4201637 - RNA, 65 nt, Human
uguauugcauuguuucaagcuguuaccuagagaaaaucagauuacaguguuuggcaaugcaugca

SEQ ID NO: 4201638 - RNA, 64 nt, Human
uguauuggacuuguguuaacaaggugcuguagcuuucacagcaagagcacaguuuccacaugca

SEQ ID NO: 4201639 - RNA, 77 nt, Human
uguauuuauauuccacaacaaccaagcauauacauauaauuguaugugugugaauguguguguguagaguauuuuua

SEQ ID NO: 4201640 - RNA, 55 nt, Human
uguauuucuuguguucccauccugaucauuaaaggaaaggaauauaugaaguaua

SEQ ID NO: 4201641 - RNA, 55 nt, Human
uguauuugggucacaagaugggaagaaaaauuaucccuucuugggucaaaguaua

SEQ ID NO: 4201642 - RNA, 59 nt, Human
uguauuugugauaacgaccugaauuuuuguagguacagguuacuuaagucagaaauaca

SEQ ID NO: 4201643 - RNA, 85 nt, Human
uguauuuuccaagcucugauaguauuggugauuuauagcauuuuugcuucagauccuaauuugucuuuguuuugaauuuuuuaca

SEQ ID NO: 4201644 - RNA, 83 nt, Human
uguauuuuugugcuugcaacuuuccagauguaucacucuaaaaugccgucugcuguucagagauguugcuaguauuuagagca

SEQ ID NO: 4201645 - RNA, 95 nt, Human
uguauuuuugugugaauuguauguggaaucaaauauguauguuuuucguagaacauguguggacaugaaucuacaugagcaugcaagugaauaua

SEQ ID NO: 4201646 - RNA, 71 nt, Human
ugucaaacauagggacuuuguggucacucuguauaucacagauugcucuuauaauaguccuuauguuagca

SEQ ID NO: 4201647 - RNA, 109 nt, Human
ugucaacuuuauggauguacauuaccuguguucaaugacuucaucuuuccuuuuaaggaaagaucauugucuuguagcaacgaggugagaaagucaggaaagcuugaca

SEQ ID NO: 4201648 - RNA, 74 nt, Human
ugucaagucgaaggcuuuuuggguaauuguagguccugucuucuacuuuuucccaagagcuuuaaaacuguaca

SEQ ID NO: 4201649 - RNA, 64 nt, Human
ugucaagucucugaaugaaaugcacuuuuuucaacggaagacuuuuuucuucagagacauugca

SEQ ID NO: 4201650 - RNA, 61 nt, Human
ugucaaucauaaugaagugaagaaccccauaacugguucauucucuauuguguauugcaca

SEQ ID NO: 4201651 - RNA, 58 nt, Human
ugucaauguacguuuaucaguugucacaaauuugauacucuggugaggguuauugaua

SEQ ID NO: 4201652 - RNA, 65 nt, Human
ugucaauuaaggagcaauugcaaugaugaaaagcauaaggcaauggcauucuugacaagcugaca

SEQ ID NO: 4201653 - RNA, 66 nt, Human
ugucacaauguaggcugaaaaagcuuugugaacguuccacaaagcaucaacacuauauugaugaca

SEQ ID NO: 4201654 - RNA, 55 nt, Human
ugucacagagcgugcaacagaagggccucuccccaagaugcaugcgucugugaua

SEQ ID NO: 4201655 - RNA, 74 nt, Human
ugucacagucgucuuccaugggugcugugcucuaaccagggcugcaaggcauugaugggagaugguggauggca

SEQ ID NO: 4201656 - RNA, 63 nt, Human
ugucaccaugcagguuauaugugcuucuguuuucauugcuggaagagaaccugcaagguggug

SEQ ID NO: 4201657 - RNA, 65 nt, Human
ugucaccuuacagucagauaagcacagaaaaauaagcagaugcuaaucuguuucccaaggugaua

SEQ ID NO: 4201658 - RNA, 62 nt, Human
ugucacugcaauguuguuuacagacuguaauggguuuauuaagaacauuuuguagaaugaca

SEQ ID NO: 4201659 - RNA, 93 nt, Human
ugucacuugccucauccaaucugcugacuuuagaacccaaaaaguuucuuugguaugggcuuuuggagcugaauuacaguggagggcaugaug

SEQ ID NO: 4201660 - RNA, 64 nt, Human
ugucacuuugccuucuggacuuuggagucuuuccaggaagaaauaaguuuaggggaaagugaca

SEQ ID NO: 4201661 - RNA, 65 nt, Human
ugucagacucuccagauuugggaauaauguuguucugugacgacaguucucugauggguuuaaca

SEQ ID NO: 4201662 - RNA, 60 nt, Human
ugucagaugugucuccaagugccuccagaacauggacugcagcugcaagcacuucuggca

SEQ ID NO: 4201663 - RNA, 68 nt, Human
ugucagccugagggaucuguggaauagccuacccaagagcucauagaaacccuucagaaaucaugaca

SEQ ID NO: 4201664 - RNA, 57 nt, Human
ugucaggcaggucauuaagcauuuuauauacaauugauucuuuugauaagcuugaca

SEQ ID NO: 4201665 - RNA, 55 nt, Human
ugucagggcaaagucuucuagaacccaaccugguaacugcaccuuuggccugaua

SEQ ID NO: 4201666 - RNA, 59 nt, Human
ugucagugagggaggcagaauguguggugugaaguggauucugccuccaggagcuggca

SEQ ID NO: 4201667 - RNA, 57 nt, Human
ugucaguguuuuaugugcccuuccagaauuaaaaaagugcauauacaaauacugaua

SEQ ID NO: 4201668 - RNA, 78 nt, Human
ugucaguuacacccagagauguccugagugauacagagaauuucugucagucauucacucacucggacaagaaagaca

SEQ ID NO: 4201669 - RNA, 57 nt, Human
ugucaguucugguuggcucccacuugaaccuaggucucaacgacacagagccugaca

SEQ ID NO: 4201670 - RNA, 65 nt, Human
ugucaucagcucuucauucuugauuuuugguuauauguuaaugaggacacuagagcaggugcaca

SEQ ID NO: 4201671 - RNA, 81 nt, Human
ugucauccccuaaggcaaguguuggucugagaagcgaaaccaagcuggcacagcacuguaggccugggagggaaagugaca

SEQ ID NO: 4201672 - RNA, 77 nt, Human
ugucaugcuguguuugagaaccuaggauaucccagaaaaacuuuaggaagcuugggucucaaauauuguaucuuaca

SEQ ID NO: 4201673 - RNA, 109 nt, Human
ugucauuggaguaaugcuaggcucuguauacugaucaaacugagguucauaguuauuuuuaauauuucagcaaugacagccuauauaauaaucuagcuaucuguagaca

SEQ ID NO: 4201674 - RNA, 56 nt, Human
ugucauuuaaagcuuuccagauuugaagaauguguggaaggccagaaagaaugaca

SEQ ID NO: 4201675 - RNA, 67 nt, Human
ugucauuuaggcaaugcucucaaauuugguauaaucuuacuuaggccugaagcuuugccuagaaaca

SEQ ID NO: 4201676 - RNA, 117 nt, Human
uguccacugcuuuuagggaagaggccuuggcaaguggaaugcucuuccucccuuggacuugauagggaggaggaauguuuuguguagcaacuucccucucucccuuuggggugggca

SEQ ID NO: 4201677 - RNA, 65 nt, Human
uguccacuuugauaauagaagcacuggaacaaguauaucccaguguuccuucacagcaguggaca

SEQ ID NO: 4201678 - RNA, 83 nt, Human
uguccagaggggcccguagccagugggacggugcugcacguggucgugccucaagcccuccacugcaccgggcgcccuggcca

SEQ ID NO: 4201679 - RNA, 72 nt, Human
uguccagauacuguuaauguuaaauucagggagaagcucccuaaagucauguaacaguuuaaucauuggaca

SEQ ID NO: 4201680 - RNA, 62 nt, Human
ugucccccuuuggcuuuuguuacuaacuuuaaugaccacaacauuuaggccaaaaaggggca

SEQ ID NO: 4201681 - RNA, 61 nt, Human
ugucccugcaucugcaggccaugucaaaggacgcccugaaucuggcgcagaugcaggagca

SEQ ID NO: 4201682 - RNA, 93 nt, Human
ugucccugcuuuuauuuaaaagaaugcagugccuuccagcccccaccuugcacucuuaggcgcuucuaggcaaauguauucugaagcagaaca

SEQ ID NO: 4201683 - RNA, 71 nt, Human
ugucccugugcagagaagccacugggggaauaagaucaguuagcccccacaccaucucuugcaaggugaca

SEQ ID NO: 4201684 - RNA, 95 nt, Human
ugucccuuucuuuauccuagucccaaugucacaugguucuggggccucaucuucagugcuagaguuucaaggauuauguguacuuggaggggaca

SEQ ID NO: 4201685 - RNA, 75 nt, Human
uguccgggaagcguaugcccaguuguucacaggacacacacacagauccaaagacaccaggcguggcccucgaca

SEQ ID NO: 4201686 - RNA, 73 nt, Human
uguccuagauaugacuagaagcucauuuuuacccugaauuuguggaauugagauaugacagucauaaagggca

SEQ ID NO: 4201687 - RNA, 73 nt, Human
uguccuaggucagggucuuuguugcaugcaucguccuguccuuagcaagagcuacccugugccauaugggaca

SEQ ID NO: 4201688 - RNA, 93 nt, Human
uguccucacaucuggaaacuugaguuuucugugugugacccaggagacuggcucauauuaacaaugaaacucagaagagagagguguggguca

SEQ ID NO: 4201689 - RNA, 60 nt, Human
uguccucaucuuuuccagaaauaucccauaaagcuggauuaagaggaugaugugaggaca

SEQ ID NO: 4201690 - RNA, 66 nt, Human
uguccugaacacaaugugauggguguuuuuuauuauaaaaaugcuuagagguguucaaauuggaua

SEQ ID NO: 4201691 - RNA, 72 nt, Human
uguccuggcauggacuagugcugaggugggaaauagaaaauucacauuugguuucugggccaaguuggggca

SEQ ID NO: 4201692 - RNA, 126 nt, Human
uguccuucauuugagcuaauaucgugacugaaagcacagcaaucugagagacauaguuauuuaaauuuaaaauugugcucacagcuuguuucuaagagaucaauuuauuaguccaggugggagaua

SEQ ID NO: 4201693 - RNA, 65 nt, Human
uguccuuguuccuaauguaaaaggugcuuaacugcuucuugguucuauuggguagcauugggaua

SEQ ID NO: 4201694 - RNA, 57 nt, Human
ugucgagcagagcagagacgucugguggagacagccgggugcuggagcucucugacg

SEQ ID NO: 4201695 - RNA, 70 nt, Human
ugucggugcaggccagcuugaugaccugugggacaucacagaagaaguuguccagcugguuugggccaca

SEQ ID NO: 4201696 - RNA, 70 nt, Human
ugucuaaccauauucauguacagccaauaguuguugagugcuuacugugugcuggacaugauguuagaca

SEQ ID NO: 4201697 - RNA, 106 nt, Human
ugucuacauagcaggaaugaaauagaaguuaauuaaauuauuacugaaugaucaagugagaguauuaaugugaacuuccaauuucuuuacccuauucuagcagaua

SEQ ID NO: 4201698 - RNA, 59 nt, Human
ugucuagaggccaacaggaaagggucaucagaaacccacuguucuggugcuucaggaua

SEQ ID NO: 4201699 - RNA, 81 nt, Human
ugucuagcagggucaucugagggacgagauuucagagugaacaccuugaacucuugguggucauuagaugguccugugaua

SEQ ID NO: 4201700 - RNA, 70 nt, Human
ugucuagccagguggcugagcagcugcaggaagcccucagcccugcucccgccaccaccuguggcuuuca

SEQ ID NO: 4201701 - RNA, 73 nt, Human
ugucuauuuaaaaggaauguuucaagggaaucauugcauguuuauauccuugacuuugccuuuuaaauguuca

SEQ ID NO: 4201702 - RNA, 93 nt, Human
ugucuauuuccugggcggugggcguucuucauucugugagccacuuggcuuuuacaguggaccugccauucuguggucccaaugagguggaua

SEQ ID NO: 4201703 - RNA, 85 nt, Human
ugucucaucauuagcuauuugggcagguggauguugauacagguuauucuuaggcaucagugccccauggcuaaugcuguaggca

SEQ ID NO: 4201704 - RNA, 58 nt, Human
ugucuccuacugccuguggaucuccuugcaggcuugagaccacugggguggugggaca

SEQ ID NO: 4201705 - RNA, 125 nt, Human
ugucuccuccacuagauccgagccaguggcucugcccagguggacagcagagucgccgcugagauucuaacugcuuccaucggggcucucggagcagcuguuggaacaggauggggagcagagca

SEQ ID NO: 4201706 - RNA, 89 nt, Human
ugucuccuuggauuuuguuuuauaaacuaguguugagggauuuuuauaaacuuccaaagcacagguaauacagaguaacaguaagcaca

SEQ ID NO: 4201707 - RNA, 72 nt, Human
ugucucuaaauguuccucgagcuccuaauucagccugauagaagguuagaggugagaggaacuuuggagaua

SEQ ID NO: 4201708 - RNA, 59 nt, Human
ugucucuggcccaugagcagagugggcuuuuaauccuuagccugaguguuucagagaca

SEQ ID NO: 4201709 - RNA, 56 nt, Human
ugucucugucuuccagggcuguucacucuacagcuagauggcucagcacagagaca

SEQ ID NO: 4201710 - RNA, 77 nt, Human
ugucucuuaagacucuaucuggcuuuauagugacaacaucaaaggauauuuguauuaguuaggguucugcagagaca

SEQ ID NO: 4201711 - RNA, 57 nt, Human
ugucugaagugcuguaugcauguuguuguucucaaggagaggcaggacacucagaca

SEQ ID NO: 4201712 - RNA, 92 nt, Human
ugucugaauauguguauguguguguguguguauguucauagggagaaaaauuuccucuccuggaacacagaugcauuacacaucuauggaua

SEQ ID NO: 4201713 - RNA, 63 nt, Human
ugucugaauucaagaaauucaauaacuccaccccaguggcuaguuggguuacuugauggcaca

SEQ ID NO: 4201714 - RNA, 58 nt, Human
ugucugagcuuuaugauggaagagaccacaccagucuuguucagucauauucucaaca

SEQ ID NO: 4201715 - RNA, 82 nt, Human
ugucugaguuuuuauacaggugcucuacagacaggacacucauucaagggggucuugaaaugcgauaggcauuuuucaggca

SEQ ID NO: 4201716 - RNA, 74 nt, Human
ugucugcagaugcuagcacuucugaggcacagaaaaugaaugguuuuaaaugugauccugguaugcacuugaca

SEQ ID NO: 4201717 - RNA, 130 nt, Human
ugucugccauauuuccuacacagcgauuuuggcuacauuaagcuuuugcacugagagcauaaagaguuuugagaaaaagugaugaugaugauggcucaauccaugugggaaauuaccauauaaacagaca

SEQ ID NO: 4201718 - RNA, 66 nt, Human
ugucugccuuugugaucaguucuuucguuugauauuuuugcagaaggaacugcaucagcacaguca

SEQ ID NO: 4201719 - RNA, 61 nt, Human
ugucugcuagcugguggcaauugaaguaagcauucucuucucccacagagacuagaagaca

SEQ ID NO: 4201720 - RNA, 65 nt, Human
ugucuggccucaaaagccauuuguaaagcuaacaaacaaaucacaaggcaaauugaggccaguca

SEQ ID NO: 4201721 - RNA, 63 nt, Human
ugucuggcugaagcuuuugcagcucuucagugauggagcugggaugauaaccucagucagaca

SEQ ID NO: 4201722 - RNA, 59 nt, Human
ugucuguacuggcugcaucgauggcugcaggaaggagaguugagcuuuuaguacagaca

SEQ ID NO: 4201723 - RNA, 58 nt, Human
ugucugucuguccuucucauuauguguucauuucuaucuggugaggaagcagaaguca

SEQ ID NO: 4201724 - RNA, 59 nt, Human
ugucugugguauaaaugacauccuugugcagugcacaaugggugcaacuauccaugaca

SEQ ID NO: 4201725 - RNA, 59 nt, Human
ugucuguugugcuuauagucagcauaaaauaguuuugcuguugcuaaguagugcaggua

SEQ ID NO: 4201726 - RNA, 61 nt, Human
ugucuguuuuguucacuguucuuccucagcacuuagaacuaugccuggcacagagcagaua

SEQ ID NO: 4201727 - RNA, 99 nt, Human
ugucuuaacauguuugaaccucacagagcccagaugucuaauuguauguucuuuuugucuuuauauggacaacugguuuuugacaaauguguuaaagca

SEQ ID NO: 4201728 - RNA, 60 nt, Human
ugucuuaauuucccuuugucauguaauguagcauauucacaaguucugggaauuaggaca

SEQ ID NO: 4201729 - RNA, 108 nt, Human
ugucuuaguugcccuuuauaauggaauugauuuuuuuaacucacaggaucagauuucuguacaugaguucuguguccuuuaaaaaagacacuuuggggaugcugagca

SEQ ID NO: 4201730 - RNA, 67 nt, Human
ugucuuccuccagcaggacugaggcccagggaagaauagucagcggggucugggguguugagggaca

SEQ ID NO: 4201731 - RNA, 80 nt, Human
ugucuuccuucuuccauccaugucccguuucuggcuuuguggcugaggcaggaaugggugauggugguguguggugagca

SEQ ID NO: 4201732 - RNA, 61 nt, Human
ugucuucuagucucugugggagaagagaaugcuuacuucaauugccaccagcuagcagaca

SEQ ID NO: 4201733 - RNA, 94 nt, Human
ugucuugaucaguagugugagaacggacuaauaaauauaucaugcuuugagguauauauuguuaguuuucaauacguaucaacuaaucaaaaca

SEQ ID NO: 4201734 - RNA, 86 nt, Human
ugucuugcacugccagcugggucccugcuggggcucugggacuuccacuucucaguccacauaggaacccagcuuccacugaguca

SEQ ID NO: 4201735 - RNA, 66 nt, Human
ugucuuggcaugcaugggcaaucagauguuugaagaaaauugaugaauaaccauguguccaagaca

SEQ ID NO: 4201736 - RNA, 95 nt, Human
ugucuuuaguucugagauaagccgcugcacugauucuguugucuggguccagacaagggaauugugugugagaggcagcacuuagaguucagaca

SEQ ID NO: 4201737 - RNA, 77 nt, Human
ugucuuucaugauccaggaaucuggggccucugcaaacaccacgcaacagaagggcuccacuugaaucacacagaca

SEQ ID NO: 4201738 - RNA, 103 nt, Human
ugucuuuuaagagcuuuugauacaauacugaguuuacauucaucuguuauuuauugaacacuugcuggugaaaggcaucaguguuaucugcucuuagggaaca

SEQ ID NO: 4201739 - RNA, 67 nt, Human
ugucuuuuccauucacuaauuaggggaguaauguuccuccuuugguuguagacaggaauauuaagca

SEQ ID NO: 4201740 - RNA, 82 nt, Human
ugucuuuucuggccauggcaagccgaguguugggagagaagaaugcacgccugguauucagugcuguggcacagacaaguca

SEQ ID NO: 4201741 - RNA, 85 nt, Human
ugugaaaacaugagauuugggaggggccagggguagaaugauaugguuuggcucuguccccacccaaaucucaucuugaauuaua

SEQ ID NO: 4201742 - RNA, 63 nt, Human
ugugaaaaugcagauucugcugcagcaggucuggcugggaccugggauucugcaguuuucaca

SEQ ID NO: 4201743 - RNA, 59 nt, Human
uguuucaguccacuuaggcagccauaauaaauuaccauggacuagguggcuuguaaaca

SEQ ID NO: 4201744 - RNA, 77 nt, Human
uguuucagucuggaagcccuggcauuucuauucauguccacagcauggacaugaggaacucaggagucaccagagca

SEQ ID NO: 4201745 - RNA, 77 nt, Human
uguuucauacaggaggugcuguuuguccuggauuuuagagaaagcuuccagagagauaguggcuaauaaaugaaaua

SEQ ID NO: 4201746 - RNA, 78 nt, Human
uguuuccugcuuuaggggcuggccauuguacaaggugaaauuuuaaaauucuaaagcaaugaaaguuuugcagaaaca

SEQ ID NO: 4201747 - RNA, 81 nt, Human
uguuucuaauuggauagcagaauaucccuaguagcuguaaauguuggcuucugugguaaacuuuguuguaaauuuaagaca

SEQ ID NO: 4201748 - RNA, 78 nt, Human
uguuucuauucucaucuccuuggaucacguuuagucacuugacugcaccuaguggcaacggaguauaggaaggaaaua

SEQ ID NO: 4201749 - RNA, 61 nt, Human
uguuucucagaucuugcugcuucuuucaaaauggaaagaggccaccuucucuugagaaaca

SEQ ID NO: 4201750 - RNA, 66 nt, Human
uguuucucugaagauauuuauuauuaugcaauaacuuaauaguuuguaaauaucuucaugguggca

SEQ ID NO: 4201751 - RNA, 63 nt, Human
uguuugaaguaaaugauuaaaagaggaggaaguuaccacauucuggaagauuuacuugagaca

SEQ ID NO: 4201752 - RNA, 86 nt, Human
uguuugagacuuuaccaagaguugucacuguuucagaaugucaguucaugacagggacgcugcucuagguauucgagucuucaaca

SEQ ID NO: 4201753 - RNA, 55 nt, Human
uguuugcaggaacucuggggagagugccguggcuucucccacauuucuucaaaua

SEQ ID NO: 4201754 - RNA, 85 nt, Human
uuagagccagagaaugcagggcuucggacaacaaagaccucuggggacagggcagaugucccugagccuggauuccugccucuga

SEQ ID NO: 4201755 - RNA, 130 nt, Human
uuagagcuuccuugccacuguccaaagagagucuuucucuuccuguuagggguuuccuuuuaugacacagaacuagaagacagacagagaaugggcuugagauccauggaugaagggaaggguuuaauga

SEQ ID NO: 4201756 - RNA, 60 nt, Human
uuagagguaguguaugugaaacuuuccaaagcacuuuuugcuugcauauuuuaccuuuaa

SEQ ID NO: 4201757 - RNA, 57 nt, Human
uuagaggucaggucgcagaggaagcacugguuaccaagucgcagaccugaguucuaa

SEQ ID NO: 4201758 - RNA, 101 nt, Human
uuagagucaguucagugcuguuccaugucuuuguaggacugucaucaggagacuggaaguucugggaaaaacauggccaaugguuugaauucagauucuga

SEQ ID NO: 4201759 - RNA, 81 nt, Human
uuagaguugauguuguaucagugccuauaaaaugaauuaaaugaauucauauuuuaguugcugaacagcaguuguagcuga

SEQ ID NO: 4201760 - RNA, 88 nt, Human
uuagaguuuagguggagaacucuuucaguaccauugaguguucucuaguaagaggaucuuacacuguuggguuucucacuugcuuuaa

SEQ ID NO: 4201761 - RNA, 63 nt, Human
uuagauaguauuguuggaaggguaaguugaucauauuaaauugcuuuucaaggguacagcuaa

SEQ ID NO: 4201762 - RNA, 60 nt, Human
uuagauagucuucacugugaauuuguucuugcagcaaguggaagaaugcagugugucuaa

SEQ ID NO: 4201763 - RNA, 76 nt, Human
uuagaugauuuuaagugaaggaccaauaugacucauguuacaugagcagauauggauuuuagagaggucaaucuga

SEQ ID NO: 4201764 - RNA, 76 nt, Human
uuagauucuacuaaaggcaguuggaguugaggaaauuaguugaaugcuuccucgguaauugucggugaggauguga

SEQ ID NO: 4201765 - RNA, 82 nt, Human
uuagauucucauaaggacagcgcaaccuagaucccucacaugcacgguucacaacaggguguguucuccuaugagaaucuaa

SEQ ID NO: 4201766 - RNA, 124 nt, Human
uuagcacccacagaugguuucagauacacucagaugucacaggcauccaggacuaggccugcuuugaucauuuggagggcaggauuucuggauaccugcgucaccuguagccaucuacugcuga

SEQ ID NO: 4201767 - RNA, 80 nt, Human
uuagcacuaguguuuaagaagaugacuuuggaguuggagagacagguucaaauccagacucugucacuuccuaguaauga

SEQ ID NO: 4201768 - RNA, 115 nt, Human
uuagcagagugcuuaugaagauaguuucuucuaaaugugcuuauuaauauaauauauauacuauuaaugaaaggcaguuuggaacugggaucauuaaacauuuccacucugcuaa

SEQ ID NO: 4201769 - RNA, 64 nt, Human
uuagcagcggucaguuuugaagcucuaaagugaagcggagcuuuagguauuuccccuugacuaa

SEQ ID NO: 4201770 - RNA, 66 nt, Human
uuagcauaagggcaagcucuuuaguguccuucaaagcacauauguaaauagcugccuguguacuaa

SEQ ID NO: 4201771 - RNA, 111 nt, Human
uuagccaagcaaggugguguaugucuguagucccagcuacuugggggucugagcuggagcccaggagguuggggcuacagugagcuguguuugcaccacugcccuggguga

SEQ ID NO: 4201772 - RNA, 118 nt, Human
uuagcccaaugccucuuguauaacauucaaaaaaguuagcuauuaguaggugcuauaaaauuauaaaguuuuuacucucugaccuuuggaguugaaacaguggcauuagauggguuga

SEQ ID NO: 4201773 - RNA, 65 nt, Human
uuagcccuggcacagguuccaaggggguggaauuagaacccaucguggaaccuaggcagagcugg

SEQ ID NO: 4201774 - RNA, 84 nt, Human
uuagccuuccgcuacacuggccuucauuuguaugggauccuucuuuuuaugcagccucaguaucagaacgagccaggagguuaa

SEQ ID NO: 4201775 - RNA, 79 nt, Human
uuagcucaaguauuauggggguuuaauccacucuagagaaaauggaguaaaggaagaauucucugugauggugggguaa

SEQ ID NO: 4201776 - RNA, 80 nt, Human
uuagcuccugcaccacaguuccucgcuguccaccccaggcuuccggacuggaaggacagugggacagugacgggggauaa

SEQ ID NO: 4201777 - RNA, 121 nt, Human
uuagcuguuacuacaacacaaacuuucauucugucauucuuacauaaugugacccauucaaaggaugugucagcauucaugaagucaugacucagaagacgaugagcugugucagagcuga

SEQ ID NO: 4201778 - RNA, 66 nt, Human
uuagcuguuggcuuacaucuguuggacuauuucaaauaucucccagcauugccugccuauugcuaa

SEQ ID NO: 4201779 - RNA, 78 nt, Human
uuagcuucaggguagggcugaggcaacaagggagugggcuuccuuagcagccccaaagccugggccuccugaagcugg

SEQ ID NO: 4201780 - RNA, 82 nt, Human
uuagcuucugcagacuugauaaccacugggagauacaccuguguauagggcgguugugauugaagucugcagcucuagcuaa

SEQ ID NO: 4201781 - RNA, 90 nt, Human
uuagcuuugggauguuuugucaaaucaaaccacauucuuuagauaaggaguuugguuugcuuugauauuuagugaccuucccuuagcuag

SEQ ID NO: 4201782 - RNA, 86 nt, Human
uuagcuuuucauggggugaauuaguaugcuacagaauaauuuaguuauuuaaggcagcuauaguacuucucuccuuggcuggcuaa

SEQ ID NO: 4201783 - RNA, 69 nt, Human
uuagcuuuuccauggauuuuguuacuaucuuuuuucucguuacugggauaugugucuguggaaaacuag

SEQ ID NO: 4201784 - RNA, 67 nt, Human
uuaggagagcagugggguccucaguaugguuccuuuaggcagcucugcugaccccacccuuuccuga

SEQ ID NO: 4201785 - RNA, 71 nt, Human
uuaggauauugagagagugagguguagaauuuaaaguuaaaaaauuuuacaucacuuuacuuaauaauuga

SEQ ID NO: 4201786 - RNA, 77 nt, Human
uuaggauuugcuuuuccauuguaguaucuguuuuaguuccuuaggacuggaaaacugagugggauugcaucuauuga

SEQ ID NO: 4201787 - RNA, 70 nt, Human
uuaggauuuuugaugaggauugcauugaaucuguagauagcuuugaguauuauugucaucuuaaucuuaa

SEQ ID NO: 4201788 - RNA, 87 nt, Human
uuaggcauuccggacaagacaauucuucguuguguguggagagggaggcuguccugugcuuuggaggauguucggcagcaugucugg

SEQ ID NO: 4201789 - RNA, 76 nt, Human
uuaggccaugcagcaaagaggcuaguuuuccagaauuggauccacuucuucuaggcauccuugcuguaauguuuaa

SEQ ID NO: 4201790 - RNA, 129 nt, Human
uuaggccgcuuugcaucaggagcccuaagggucuguggccauuuggaaggcaaguaggcagaauagcuaccugcauggcuuccagugcuuacggagagaggaggggaauauggcauggcaaagugggga

SEQ ID NO: 4201791 - RNA, 57 nt, Human
uuaggccuuugauuggggugcucugugcuacagguagugccaaaucgagggcucuga

SEQ ID NO: 4201792 - RNA, 84 nt, Human
uuaggcuauaaaaguuugagaaaaccagaaagaucuugacuucauagauuuuuuguuguugucucauaguaaauuuuauucuga

SEQ ID NO: 4201793 - RNA, 63 nt, Human
uuaggcucucccuggauuuccaaguguugcuaaauuuaguucauucuaaccaggagaggcuga

SEQ ID NO: 4201794 - RNA, 55 nt, Human
uuagggaaauaaaauuaucaguacaguaaacuggaaggcuguuucuuuucccuga

SEQ ID NO: 4201795 - RNA, 103 nt, Human
uuagggcauuuucauauauucuugugauuauaaaguaguauguucaaguuuuaguaaauuaauauuacguuaucagguaugcaagaggagugagaaccacuaa

SEQ ID NO: 4201796 - RNA, 61 nt, Human
uuaggguagauuugcauuuuaaaauugcucauaagacaaaaaaauguagacuuuucccuga

SEQ ID NO: 4201797 - RNA, 59 nt, Human
uuagggucuagaauggaugagcauuuuuuuagaaggagcucagcaacucuagaaucuga

SEQ ID NO: 4201798 - RNA, 71 nt, Human
uuaggguuucuuuuuggauagcugaugaaacaaaguuccuauuguuucauccucaaaagagagggcccaga

SEQ ID NO: 4201799 - RNA, 63 nt, Human
uuagguaaauuccucucuuugggccucacuugcaacaccaauaaagagaggaaguuauacuag

SEQ ID NO: 4201800 - RNA, 67 nt, Human
uuagguauaaaugauuggcaagucucaaccuugcuaaaacugagacuuuucaauuagcuaugcuuaa

SEQ ID NO: 4201801 - RNA, 72 nt, Human
uuagguugcuacaaaaguaauugugguuuuugucauuaaaggucauggcaaauuacuuuuguaccuacuuaa

SEQ ID NO: 4201802 - RNA, 79 nt, Human
uuagguuggugcaaaagcaguuggauuuuuugccauuaaaaguacaggcaaaacagcaauuacuuuugcaccagccuaa

SEQ ID NO: 4201803 - RNA, 79 nt, Human
uuagguuggugcaaaaguaauugcaguuuuaccauuaaagguaauggcaaaaaccgcaauuacuuuugaaccaaucuga

SEQ ID NO: 4201804 - RNA, 63 nt, Human
uuagguuuaugaggucugcauuguuaccaagaagugauaugguuugcagcuguaugagcuuaa

SEQ ID NO: 4201805 - RNA, 96 nt, Human
ugugaaaucauuuuacacuacuugguuuauauccaaaggcaaggaggaaggaaccuuccuccuugccuuuggauauuaaaguagaaugguagcaua

SEQ ID NO: 4201806 - RNA, 93 nt, Human
ugugaacuauuacgugcuuucuaaaggcuuuuuguuuaaaugcuauuuauuuaucuggcaucaguaaaaccugcuuuuaguguauguuucaca

SEQ ID NO: 4201807 - RNA, 71 nt, Human
ugugaagaacuggcaggucaucaacuguaauuuuuuuuaauuaaaaaauuaagaugaucuucaaaggcaca

SEQ ID NO: 4201808 - RNA, 68 nt, Human
ugugaagcauacaguaggugcucaguuaaggcugauuuccuaauugagugacugcugcaugucaagca

SEQ ID NO: 4201809 - RNA, 56 nt, Human
ugugaaggcagccaucgacaguuuggaaauaggcaaauaggcauggcuguguucca

SEQ ID NO: 4201810 - RNA, 91 nt, Human
ugugaaggcauaagauuugggaggggccaggggcagaaugauaugguuuggcucugugucuccacccaaaucucaucuuguagcucccaua

SEQ ID NO: 4201811 - RNA, 55 nt, Human
ugugaaggcuaauuaaacaaguucgcuuuugaaauaugaccucuuagccuuuaca

SEQ ID NO: 4201812 - RNA, 61 nt, Human
ugugaauaaucacccuucuggaugauugauugcuucaguucacugaaaguguuuguuuaca

SEQ ID NO: 4201813 - RNA, 78 nt, Human
ugugaauaaugauguguauuaguuaguuuaaugucuuccaagugcauuucauuuugaaugauauacucagauagcaca

SEQ ID NO: 4201814 - RNA, 60 nt, Human
ugugaauaaugccgcaauaaacauacgugugcaugugucuuuauagcagcaugauuuaua

SEQ ID NO: 4201815 - RNA, 102 nt, Human
ugugaauucuuagcucugccaggagaggcucuaacucuguguuuuugauagacgggaaaggcuacaguuucucuuguuccuuugcagagcguaaaauuuaca

SEQ ID NO: 4201816 - RNA, 56 nt, Human
ugugacagugccagcuucauagccuagucuaggcaugccaguugcccacuguggca

SEQ ID NO: 4201817 - RNA, 64 nt, Human
ugugaccguggggacuugcucgggcuuuuguucccagaaaguaagaccaagugaucauuucaca

SEQ ID NO: 4201818 - RNA, 59 nt, Human
ugugaccuuauuuggaaguagggucuuugcagguguaauccaguuaagaugaggucaua

SEQ ID NO: 4201819 - RNA, 67 nt, Human
ugugaccuugaccauuucccccaccauuaagaucuuggaggucaaagggugagauggcaggauugca

SEQ ID NO: 4201820 - RNA, 81 nt, Human
ugugacucagacagcuggcagguccaagauagagcauauggaugaugcucuaaugacaucuguccaguuguuguaaucaca

SEQ ID NO: 4201821 - RNA, 62 nt, Human
ugugacugauccugcaaguguguugacuuauuuuucugcacaaggcaacauagaucagggca

SEQ ID NO: 4201822 - RNA, 64 nt, Human
ugugacugcugcgacugcuucucaucaccccagaagauggagaauggaauguugugcaggaaca

SEQ ID NO: 4201823 - RNA, 60 nt, Human
ugugacuucauuucauaguuguuaaggcccugguauacaauaacaguaagugauguuaca

SEQ ID NO: 4201824 - RNA, 55 nt, Human
ugugacuuuucuuuuguaugcuaaaaucuagcagaaacacagggcuagaguuaca

SEQ ID NO: 4201825 - RNA, 61 nt, Human
ugugagcaccccgcaaaugugcaagaauauuaucaguucggcauguguggugugcuccaca

SEQ ID NO: 4201826 - RNA, 68 nt, Human
ugugagccagaguugaaugugagucucuccaaaauagaggcagauacaguuuagucucugguaaucca

SEQ ID NO: 4201827 - RNA, 67 nt, Human
uggagagaagucacccuagggccuggacuguggugauaauggugcugguucaggguggcuguuucca

SEQ ID NO: 4201828 - RNA, 88 nt, Human
uggagagaguggauucagacagaagagcuggcucugugcugguuuuccaggggucagcccuuuugucagcgacgagucugccucucua

SEQ ID NO: 4201829 - RNA, 56 nt, Human
uggagagcacaguuccugcuuccaaauuggcuugaaguggggacaucugcucugca

SEQ ID NO: 4201830 - RNA, 97 nt, Human
uggagagcccuugauguuuauugcaaauaaugcgagccaguuuugucauuggcacuuacugguuuuuugcuuguuuguuagauaucuguaucuucca

SEQ ID NO: 4201831 - RNA, 66 nt, Human
uggagagggcgcccaggcccacgccaggaucacucagcuugaugaaggggcuggugcccucugcca

SEQ ID NO: 4201832 - RNA, 93 nt, Human
uggagagguaucaugcucagcacuuugaagcagaaggaugucuaucuuauucaccugucuuuaauagugccugggacacagcuggugacucca

SEQ ID NO: 4201833 - RNA, 63 nt, Human
uggagagugguuugggggacaucgaagguggccuucucaccugcuccccacgccagcuuccca

SEQ ID NO: 4201834 - RNA, 111 nt, Human
uggagaugagcucgucaugauuggccaggugugcucugcaguggauacagcuguacguucggugacaguucggcagauacgcuuggaaaguuuuggacuuugucauuuuca

SEQ ID NO: 4201835 - RNA, 56 nt, Human
uggagauggggcuuucucuagcugagauguuccagccacagccagagcuaucucca

SEQ ID NO: 4201836 - RNA, 64 nt, Human
uggagauucuaagucguugguuagugguacucauuaacaguuaaacaauuggcuagaaucauca

SEQ ID NO: 4201837 - RNA, 76 nt, Human
uggagcaagaaccaaaaugaagcuagguuuguucaaucauacuuaaagaggcuacuuuugguuuauuuugucucca

SEQ ID NO: 4201838 - RNA, 77 nt, Human
uggagcaugugggccccuuuagaggccuggcagagucuaagugggccuccagaggguuucccaugaaaaagugacca

SEQ ID NO: 4201839 - RNA, 105 nt, Human
uggagcauguugagugcacgacuuguuauggauccaagaaagacgcuccuuggcuuucuuguaagauguuuauuaaagcaaguccugcccuuuccccaaccucca

SEQ ID NO: 4201840 - RNA, 61 nt, Human
uggagcauugugcuaagacacacccccccgguguggggauguaagaagggccagagcucca

SEQ ID NO: 4201841 - RNA, 58 nt, Human
uggagccaaugaacauuugcuggaaucccuuucuuuaaagcaguguuucuugacucua

SEQ ID NO: 4201842 - RNA, 71 nt, Human
uggagccauccccacccucccugugcacauuugcugggaguuugacagggacaguggagauggaacagcca

SEQ ID NO: 4201843 - RNA, 86 nt, Human
uggagccccugccacaggagggccguuugugugccuuuaucccaucaaggcagcagcaggagcugcucuccugacgagguucucca

SEQ ID NO: 4201844 - RNA, 95 nt, Human
uggagccuaacuuccuuccacuugcaugugugcuggacuuagugacucaauuguaaagcacagaaugagguggaagugauagugugucauuucca

SEQ ID NO: 4201845 - RNA, 63 nt, Human
uggagccuaggaaccuacguauuauguauuacagcaaaugccucuggguuauucuaggagcca

SEQ ID NO: 4201846 - RNA, 74 nt, Human
uggagcucguggcuggcuaggggguucuccaugugcucauggccaggagagucugccgagccagcccagcccca

SEQ ID NO: 4201847 - RNA, 118 nt, Human
uggagcugccccggggccucuuccuccaugccaagcgcuuggcacacuuggaccugagcuacaacaauuucagccaugugccagccgacauguuccaggaggcccaugggcuagucca

SEQ ID NO: 4201848 - RNA, 68 nt, Human
uggagcuugcagggcuaagucagagccuggcgggaguggcagguuacuuccuacuuagccccucucua

SEQ ID NO: 4201849 - RNA, 61 nt, Human
uggaggacucugaaucccagcucaguacuguugcugcuggaaagggacuuaugaguuccca

SEQ ID NO: 4201850 - RNA, 75 nt, Human
uggaggagcacagcuucaccgagcccauccucaucccuaagaaagacgggcugggcuuggcugucccggccccca

SEQ ID NO: 4201851 - RNA, 55 nt, Human
uggaggaguagauuuucagagguuuuuauucugccauucugaaagcccuuuucca

SEQ ID NO: 4201852 - RNA, 91 nt, Human
uggaggauacuggugggggcuauacguuuggugaaauccaucagugauauucaagccaagcaaauaaucacccacuaauuuguguuuucca

SEQ ID NO: 4201853 - RNA, 129 nt, Human
uggaggaugguagcucucuucucacaacuccacuaggcagugccccaguagggacucgguguggcagcuccaacccauuucccuuccgcauugcccuagcagaagcuccuugagggucccacuccugca

SEQ ID NO: 4201854 - RNA, 73 nt, Human
uggaggccaggaagcccaagaucagggugcuggccuguucauuuccugguaagggcucucuuucuggcuugca

SEQ ID NO: 4201855 - RNA, 123 nt, Human
uggaggcccagaaagggagagggauuugcucaaggucacacagagaauuaguggcagagaaaagacuguagcccagaucuccugacccucaguacaguucucuuuuccauacaugcaccucca

SEQ ID NO: 4201856 - RNA, 60 nt, Human
uggaggcccaugcagaguccaugagggguggcuucuuucccacagacuguaugggcacca

SEQ ID NO: 4201857 - RNA, 56 nt, Human
uggaggcccccaggcaacagcacugaucagcucucugcugcuccucugggcuucca

SEQ ID NO: 4201858 - RNA, 112 nt, Human
uggaggcuuagagaggcuggguaacuuuucugaggucauaaagcaacuuuugggagaaaaagaccagauguagguuugugugacucugaagcacagguucuuaaaaacucca

SEQ ID NO: 4201859 - RNA, 59 nt, Human
uggagggcaucuguggucaggcugcaacuucaggggagaauuuccacagguguccugca

SEQ ID NO: 4201860 - RNA, 62 nt, Human
uggagggccuggcugcccccccaguaacucggggcucaucaggggcagagcuaggcccugca

SEQ ID NO: 4201861 - RNA, 59 nt, Human
uggagggcuccucacauucucuaugaaaauauauaauagaugagaugaggggcuuucca

SEQ ID NO: 4201862 - RNA, 65 nt, Human
uggagggcugguacuguggcugucaccucugcugggguguacaguacuucagaaccagccucaca

SEQ ID NO: 4201863 - RNA, 76 nt, Human
uggaggguccguguugccccaagggagcccagcacaccaugucuugcuugggcuggagucccuaggggucccucca

SEQ ID NO: 4201864 - RNA, 74 nt, Human
uggagguggucagucgccagguuuuauuucagugauaaaagagaagugaaucuggaucuaugaucaauaauuca

SEQ ID NO: 4201865 - RNA, 63 nt, Human
uggaguaacagaccuugcaggaaacgugaauagcaaaaccauucaaaccuggaggucacuuca

SEQ ID NO: 4201866 - RNA, 80 nt, Human
uggaguaggggcuuggggaggacgcaguguccugggcugggacccaagagacccuguggcuucgccgcuaaccccuccca

SEQ ID NO: 4201867 - RNA, 65 nt, Human
uggagucaggagggcugggaggguguagccucugccaacccugccucugcuuccuguagcuucca

SEQ ID NO: 4201868 - RNA, 82 nt, Human
uggagucaucacagcagaauuuaggaggcagaagccccacaguuucaaauuuugccuaugaguucuagcaugguagacucca

SEQ ID NO: 4201869 - RNA, 108 nt, Human
uggagucgacaaaguaguggaacuuccucuugaacacguccaggguguggcccaggaccuggcgguagucggccuugcccugggcgaucagguucagcugcuucucca

SEQ ID NO: 4201870 - RNA, 71 nt, Human
uggagugcugcuugggauagugaggaaggagcuugauuuccccuucacccugugaggcauuggcaacucca

SEQ ID NO: 4201871 - RNA, 59 nt, Human
uggagugcuuuuccauagccaaugggcacauguuuguguaucugugggaaggcuuucua

SEQ ID NO: 4201872 - RNA, 79 nt, Human
uggaguguuuccuccuauugugguuuucaugauugugcuaugaaguguucuuggaaacuaggauggaagaaaugggcca

SEQ ID NO: 4201873 - RNA, 58 nt, Human
uggaguuaguagcauuucaugacauggcuucaaccagcuguauuugcuacugacccca

SEQ ID NO: 4201874 - RNA, 69 nt, Human
uggaguuccucagauagcugaucacauuguaggcugaaaacaucuacaagucaagucuaucaaggacca

SEQ ID NO: 4201875 - RNA, 72 nt, Human
uggaguucucugauacaaugcuaauaaauuuauccaaagcuaaaauuugaaugaauuguauuagcugcuuca

SEQ ID NO: 4201876 - RNA, 90 nt, Human
uggaguucuuuagugugucaauuuaugucauucauaaauuaugcaagcccauuacaugggugaguaugaguugacuucuaauucauucua

SEQ ID NO: 4201877 - RNA, 99 nt, Human
uggauaacuucuuuugguuucauucucucaucuguauauagugaaugauccugagucuuccuagcucauagagaugucauaaugguccaaugagaucca

SEQ ID NO: 4201878 - RNA, 75 nt, Human
uggauaauccacucugcugacuuucaagauuauuauauuauucaauucucaggaauguugcagagugauugucca

SEQ ID NO: 4201879 - RNA, 71 nt, Human
uggauacuuuguaagcugucauagccgauagccuuuagguguuuugaaaccuacagucuuacaaaugucca

SEQ ID NO: 4201880 - RNA, 79 nt, Human
uggauauaugcauguuaucauuuuucaguggauauuuugcuacugugaagaucaaguguuggcuaauguauguaauuca

SEQ ID NO: 4201881 - RNA, 71 nt, Human
uggauaugacuuuucuuuaccugaauauguuuuucucuggggcaaguuuuugguagagaaaaguagggcua

SEQ ID NO: 4201882 - RNA, 64 nt, Human
uggauaugcaagucacgucucccuaggucuucugcagcccccaggagagagacuugaaucucca

SEQ ID NO: 4201883 - RNA, 64 nt, Human
uggauaugcuauacauaugacaucacacauguaagguguguaucacagugaauggcauacacua

SEQ ID NO: 4201884 - RNA, 67 nt, Human
uggauaugggauuggcuagccagugucugccacaccaaggagagacccuguuaguuccagucuucca

SEQ ID NO: 4201885 - RNA, 82 nt, Human
uggaugacuguuggcaggcagaaaaauagaauauaccagguucccauauaaagauuuauuuguugcuaugagucauggucca

SEQ ID NO: 4201886 - RNA, 90 nt, Human
uggaugccggagaccugcagggccaggccugcucugcagucccuacggcugcccauccccgcaggcauggucgcugccaggucggcagca

SEQ ID NO: 4201887 - RNA, 69 nt, Human
uggauggauugacgaaggcagcaaagccuagcagucacacugaagcagcucccugccgucaaccaacca

SEQ ID NO: 4201888 - RNA, 63 nt, Human
uggauggcuguggucuuugcccccagcucacugagacuguugagggcaaggaaacagccccca

SEQ ID NO: 4201889 - RNA, 106 nt, Human
uggauggcuuauuucagagaaugaggcaguauucuccauuccaagaggcuaccaagugccuuauggaaacaggagaauaucuucuucccccaaaugucccucucca

SEQ ID NO: 4201890 - RNA, 57 nt, Human
uggauggguggauaaaugugucagcaaugaaugcucagauuugucccuucccauuua

SEQ ID NO: 4201891 - RNA, 74 nt, Human
uggauguccaaagugccugacucauaguuagcacuccauaaagguuaacuauuauuagcaucuuugacauucca

SEQ ID NO: 4201892 - RNA, 68 nt, Human
uggaugugcaagaugagaaccaguugucaaggauucuuucuucuuuugaauuucucuugcaauauuua

SEQ ID NO: 4201893 - RNA, 82 nt, Human
uggauguugccacagcaaaguaagcugacauguauuugaggucauuugcaugagucaaacuuugcaaugaguaacucaccca

SEQ ID NO: 4201894 - RNA, 71 nt, Human
uucaacugaaauggccaaaugugggugcugauuucggcccugauuaguuuuacaucagccauuguucugga

SEQ ID NO: 4201895 - RNA, 57 nt, Human
uucaacugugucuaugcugccugcugucugcugcgggaagugucagaauucauugaa

SEQ ID NO: 4201896 - RNA, 61 nt, Human
uucaacuuuaggcaaagaaaacuuuuaaacaaaaaguauuagguuuuugucugaauuugga

SEQ ID NO: 4201897 - RNA, 69 nt, Human
uucaagacaaacauuaauuaacauguucgagacuuguugagaacaugauuggaaaaugcugucucugaa

SEQ ID NO: 4201898 - RNA, 99 nt, Human
uucaagagaguuuccaauuaguucagucaugaccaugggguggaaccaguccgggcuuccucuucuaaugauuagaucugaaaugaugaagccuaugaa

SEQ ID NO: 4201899 - RNA, 64 nt, Human
uucaagaguagauaggugccaugaagaaggaauucaacaugggcugaaaaucugcaaacuugag

SEQ ID NO: 4201900 - RNA, 74 nt, Human
uucaagauaagaggcugaaggagaaaaauacauuuuuuuguaaaugucaguaguuucuuugaguuuuucuagag

SEQ ID NO: 4201901 - RNA, 57 nt, Human
uucaggugaguauaguuaaauucuuagaauaguaagagugacucugaaccacuugaa

SEQ ID NO: 4201902 - RNA, 61 nt, Human
uucaggugucugccucuuugaguucgcugaaaaguuggaucuuacauauuuagcaccugaa

SEQ ID NO: 4201903 - RNA, 82 nt, Human
uucaguaaaagggaaauauuucucauuaagaucuuccaagaaugagcugucuuugggagguaaugaguucucuguugcugga

SEQ ID NO: 4201904 - RNA, 55 nt, Human
uucaguacaaugucugacacaguagguuugaaaugaaucuaugcauuggacugaa

SEQ ID NO: 4201905 - RNA, 64 nt, Human
uucaguacacacuauuuaaaguguuuaauccagaauuuaggugcauuguaguguguauuuugag

SEQ ID NO: 4201906 - RNA, 96 nt, Human
uucaguagaagaguauggauagucugauuugcagagcaggcuccaaauuucugaugagccuuuugaaauagaaaucugaaagcuuuuacuacugaa

SEQ ID NO: 4201907 - RNA, 105 nt, Human
uucaguagcucuauuuaggagggauauuguaucuucuguuuagaagugagaacuuauucauuuacuaagcccaguuauaugccauccacucugcaaagcacugaa

SEQ ID NO: 4201908 - RNA, 55 nt, Human
uucagucccuugcuuaaauuuacauggcugguaauugacagagcagggacuugaa

SEQ ID NO: 4201909 - RNA, 114 nt, Human
uucagugagccucugggauggccaguggcucugugcuugggaagguguuuuccuaggagaaguuagcagguccagcauagaggcacuggggaccccugaguguucuagcaggaa

SEQ ID NO: 4201910 - RNA, 128 nt, Human
uucagugaugucagaagugguggugacugguuuauuuguuuuuccgucuuagagauguuuacuguuacucugaggugucacaaggccaggcuaaccaggaacaacccuugcuuaauauugucauagaa

SEQ ID NO: 4201911 - RNA, 57 nt, Human
uucagugcagacgccgaagcccagcaugcugaggucauacagguaucugguacugaa

SEQ ID NO: 4201912 - RNA, 60 nt, Human
uucagugcuaggucgugugcugggggcacugacagccuucaggagcaggccuaggcagaa

SEQ ID NO: 4201913 - RNA, 80 nt, Human
uucaguggcacagauuuauugaagcugcugccagcaacaauuugcucugauucgcugcaguuuuaauaguuccugcugaa

SEQ ID NO: 4201914 - RNA, 78 nt, Human
uucagugggaaggggagcuggaaaggagauguggcugguaaguaauccuccucugaaguucacccaucuccagcugga

SEQ ID NO: 4201915 - RNA, 65 nt, Human
uucaguggucuaggcaauauauaaggaugguuucugauaccuuggugaugacagagauggcugga

SEQ ID NO: 4201916 - RNA, 60 nt, Human
uucagugucacccaaggguccaccaugugcucacugguggacaucccagggugaaauggg

SEQ ID NO: 4201917 - RNA, 88 nt, Human
uucaguguggggccaauagcaggagaaaugagagacagaaccuaaauguuaucauuuaucauuugugcuguaggccuaggguuuugaa

SEQ ID NO: 4201918 - RNA, 74 nt, Human
uucaguucaucaguuguacuagccacauuuaaagugcucaguagccacauguggcuggugacugccguacugga

SEQ ID NO: 4201919 - RNA, 77 nt, Human
uucaguuuagcuucauuuggcgugauuguguacuaaggauagggucuucuaauaugcaaaugaggcuguguucugaa

SEQ ID NO: 4201920 - RNA, 65 nt, Human
uucaguuugccaguauuuuauugaugauuuuugcauugauguucaucagggauauuuggccugaa

SEQ ID NO: 4201921 - RNA, 75 nt, Human
uucaguuuugguccuuucuagguauccacaucuuacccaggguugggggaaugccuagagagaaccauaacugaa

SEQ ID NO: 4201922 - RNA, 83 nt, Human
uucauaacuaucagucaugugaaauuuggcaggccccuagcccguuaguggccacagucacaugauugauuaccgguugggga

SEQ ID NO: 4201923 - RNA, 79 nt, Human
uucauaaguugcagagcaguaggaauauaguauaaugauuaaaagcauagauuuauauucaggcugcgcacaguaugaa

SEQ ID NO: 4201924 - RNA, 66 nt, Human
uucauagacauuuugcauucaagcacugcaguaaauuugggugcauauuuguaugauguuuaggaa

SEQ ID NO: 4201925 - RNA, 58 nt, Human
uucauagccacuuugaauugaggucauucagccuuuugauugaaaccauggcagugag

SEQ ID NO: 4201926 - RNA, 98 nt, Human
uucauaggaugugguuagguuaccaguaauguaacuuugcaaacagcuuuugggaauuauuuacuagcugggaaaauuuuaaucaauccuucucugaa

SEQ ID NO: 4201927 - RNA, 77 nt, Human
uucauauucccaaugucuagcugacacgguacuugguauauacaggacacucaguaaacgacaaugggauuaaugaa

SEQ ID NO: 4201928 - RNA, 93 nt, Human
uucauauucuuuucuauuacaauucugcaaggaguaugcaggcauuuccacuuuaguauucauguaaaauuggauagacucugaauaaaugaa

SEQ ID NO: 4201929 - RNA, 72 nt, Human
uucaucaagggcuuuaaguuuugagggaaaggacaucuuauuguccuuaaagaaugauaaugccaugaugga

SEQ ID NO: 4201930 - RNA, 101 nt, Human
uucaucacaucuauaaauuuauucuuuuuggggucaugugguagagaauuuuguucaccagaaguucuccaaaaagauuugaaaauuuguuagagugagaa

SEQ ID NO: 4201931 - RNA, 75 nt, Human
uucaucaggucuuuggagacaguggugucaaaguacaucccccccucuuucucccugucuccagggcugagugga

SEQ ID NO: 4201932 - RNA, 58 nt, Human
uucaucaucuacaaccaggaccacaaacuagggugccuacaugggugagacuggugaa

SEQ ID NO: 4201933 - RNA, 61 nt, Human
uucaucauugccagucuuuaaagaaacuuaaagugcaugcucuccuggcagugagacugaa

SEQ ID NO: 4201934 - RNA, 68 nt, Human
uucauccuguccugagauaaagaugaggaaagucuagcccuucucauaguuuauuuuaggaugaugaa

SEQ ID NO: 4201935 - RNA, 87 nt, Human
uucauccuucaggugcugugaaucuucauaaacuuuaaacaaaaacuuauuuuaugcugagauuucauggcauucuuaagaauagaa

SEQ ID NO: 4201936 - RNA, 55 nt, Human
uucaucuagagguucuggccgugcaugcugaguacugcacaggacaucugaugga

SEQ ID NO: 4201937 - RNA, 85 nt, Human
uucaucuuuaaaaagaccuacgauuuugguucuaauguaauccaaauauuacagaugaaaaagcuuguggauauuuauagaugaa

SEQ ID NO: 4201938 - RNA, 93 nt, Human
uucaugcaaaaauuccauuuuccagucuucuugcagcuacauguggucaaauuaccucauuuagagaauaagacauaaauggaauuucaugga

SEQ ID NO: 4201939 - RNA, 57 nt, Human
uucaugccaccuuuuaagugaagcauaaacauuugugucugcagaagauggcauggg

SEQ ID NO: 4201940 - RNA, 65 nt, Human
uucaugcguucacaagacguuuacugagugcccuuuuuucggcaggucccauugugaggcuugaa

SEQ ID NO: 4201941 - RNA, 57 nt, Human
uucaugugauaaaugugugacuaguacuuacauuucuggucauuuguuuugcaugaa

SEQ ID NO: 4201942 - RNA, 76 nt, Human
uucauguguuaacauccuaacccccaguguuauaguauuaggagguggggccuuugggaaauaguuaagacaugag

SEQ ID NO: 4201943 - RNA, 75 nt, Human
uucauuacagacuuacaaggucauaugugguuaguauuccccacuacaugaaaauaaguuugaaaauuuagugag

SEQ ID NO: 4201944 - RNA, 97 nt, Human
uucauuacucuuuuuauguuucugucuuuuuuauuauuuuggaguaauaaauauuuauuuguucuuaugaugaagcacugauucauagauugaugaa

SEQ ID NO: 4201945 - RNA, 74 nt, Human
uucauuaguuaaaagauaauuuuggacuaugucugguuguauguccaaauauucggucuuucugauuuuaugag

SEQ ID NO: 4201946 - RNA, 65 nt, Human
uucauuaguucugaagaugucuuagagccacauguccacuuaaagauuauuuccagacuaaugaa

SEQ ID NO: 4201947 - RNA, 59 nt, Human
uucauucaacaaguaguacacacaguaucuacugugugucaggcacaguugcugauggg

SEQ ID NO: 4201948 - RNA, 67 nt, Human
uucauucaacaaguguucguaaagugccugcaauaugccagccacucuacuaagcauuugagaugga

SEQ ID NO: 4201949 - RNA, 66 nt, Human
uucauucagugcauuugggagaguccugagcauccaggcaggacaugaugagugcaauugaaugag

SEQ ID NO: 4201950 - RNA, 64 nt, Human
uucauucaucccacaaacaugcuuugaacaugcacauuauguuucauaugguguggaugaagaa

SEQ ID NO: 4201951 - RNA, 57 nt, Human
uucauucauuacgugccaggcacuauucuaaguaagugcucggcauaugugagugaa

SEQ ID NO: 4201952 - RNA, 66 nt, Human
uucauuccuauuccuauuucuaaacauauggcacucaucuucuugccauuauagggaagggaagaa

SEQ ID NO: 4201953 - RNA, 69 nt, Human
uucauucuacauucuucauggcagagggccacccuguaggaccaccucacccagaggacuguuaaugaa

SEQ ID NO: 4201954 - RNA, 65 nt, Human
uucaacacuguuuggcugaguaacagugcaaagacacuuuuuauagcaaauaaaacaguauugaa

SEQ ID NO: 4201955 - RNA, 68 nt, Human
uucaacauaugaauuuuggguggacacgauucagucccuaccaccagcucaaaauucuuucuguugga

SEQ ID NO: 4201956 - RNA, 76 nt, Human
uucaacuacuuuuuuggggugcuuucaaagcaaagggggugucugugcuuugcaggaacccuaagcauggguugaa

SEQ ID NO: 4201957 - RNA, 66 nt, Human
uucaacucuucaagaucacaucuauugaauugcaguagaucuugugcaccuggucuuaagauugaa

SEQ ID NO: 4201958 - RNA, 56 nt, Human
uucaagacuccaagaaauuagugcccucuaaaauagcaguugaguggagucaugag

SEQ ID NO: 4201959 - RNA, 88 nt, Human
uucaagacuucggaugaagaacuuuagggcagaauuuagaagaaacuaaguugacuuuuaguucuuacuuuggcuuuuuggucaugaa

SEQ ID NO: 4201960 - RNA, 106 nt, Human
uucaagaucauuauuagagaaauccuuagacucucaauugaaguuacuaucuaugaaaagauucuuucagagaugucuagccuauuuucuaaugaggaccuuagaa

SEQ ID NO: 4201961 - RNA, 58 nt, Human
uucaagaugcacucggagaauugucaggguuuccugacagauuagaugugcauaugaa

SEQ ID NO: 4201962 - RNA, 64 nt, Human
uucaagucuuccaugguauucugauguuucucagcaaauuaaggaaugccucuggagucuuggg

SEQ ID NO: 4201963 - RNA, 112 nt, Human
uucaaguugaucuaucaccucuuuggcucuauuacugacuucuguauuuaacuuauucacuacuaguguuaucacaguguaaguacuagaaguaaagagagaaagacuagag

SEQ ID NO: 4201964 - RNA, 75 nt, Human
uucaaguugcucgcugacucaacaagcuucucauuuauuaggugccuacgagguccauggcagcggguacuugaa

SEQ ID NO: 4201965 - RNA, 82 nt, Human
uucaauaggugucucuguguccuccagggagauguaaaauccucuucacaucucccuggaggacacagagacacccauugga

SEQ ID NO: 4201966 - RNA, 65 nt, Human
uucaauaucauuguuuagucucaugcuuuuggauaccagaauguuuacuaaaaaugauguuugag

SEQ ID NO: 4201967 - RNA, 67 nt, Human
uucaaugaucccaugaugacagagucaucauuugaaaaagauucuauuacaugguuuaucauaugga

SEQ ID NO: 4201968 - RNA, 62 nt, Human
uucaaugcucaguccuaccuuggcucccauuaaacauuuggugcucuguggauugaguugaa

SEQ ID NO: 4201969 - RNA, 72 nt, Human
uucaauguuaagaagaauauguuaugauaagagguuccuaaagaaagcauuucauaguucucuggcauugaa

SEQ ID NO: 4201970 - RNA, 69 nt, Human
uucaauuuaauuuaagaacacuguuguguacugugugaagugccucagguaaaacuugaguuuauugag

SEQ ID NO: 4201971 - RNA, 81 nt, Human
uucaauuuuuugugacagaaagauuaagucccacguuggguacaacuuaaaaagaaucuuuucacgguacagaaagaugaa

SEQ ID NO: 4201972 - RNA, 77 nt, Human
uucacaacacauugccagagaucagcagggggaaaauaugcacaacacaauucugcauucagguaaaguguacugaa

SEQ ID NO: 4201973 - RNA, 62 nt, Human
uucacaagagggcagccaacugauccuacuaaaacuuagaucauuucaguccucugugugag

SEQ ID NO: 4201974 - RNA, 65 nt, Human
uucacagaagaggucacauuucccucuuuacagcacuagcagaauuguauaccucuuccuguggg

SEQ ID NO: 4201975 - RNA, 74 nt, Human
uucacagaaguguguauaacucuucaaaaauacagaaguauauacccuuaggaguguauacucaccucugugag

SEQ ID NO: 4201976 - RNA, 70 nt, Human
uggcagauggagauaaauggaacuuacuuuuuccaccuggugccagucccgcuuacucucuaugcugcca

SEQ ID NO: 4201977 - RNA, 57 nt, Human
uggcagcaucugaagugaauugcuuuuuggaaagagggggagucuuugaugucgcca

SEQ ID NO: 4201978 - RNA, 55 nt, Human
uggcagccaucagagcagggguggacagcccagcucuccugcuccagugcugcca

SEQ ID NO: 4201979 - RNA, 55 nt, Human
uggcagccguguugaacuugagccaagcguuuaguccucagcugaacugcugcca

SEQ ID NO: 4201980 - RNA, 72 nt, Human
uggcagcucugggggaggccuggccuccaggagaugcuccucccugaggcuggcccuuccaucccgcagcca

SEQ ID NO: 4201981 - RNA, 61 nt, Human
uggcagcucuguucaacaugaggcaguguuacaccauuguauuagucagcuugggcugcca

SEQ ID NO: 4201982 - RNA, 81 nt, Human
uggcaggcauccagcaggacguccaagugcuaucuuccaaacucuagacuagucuuccacuucuaugcgagugucguguca

SEQ ID NO: 4201983 - RNA, 63 nt, Human
uggcaggcucgggcgggggcgcggcgcggggacugaccgcccuccucugccccggggcugcua

SEQ ID NO: 4201984 - RNA, 62 nt, Human
uggcagggugggcuucagccccaccaguagcuaaggucccgguuccaagcccacccguguca

SEQ ID NO: 4201985 - RNA, 64 nt, Human
uggcagguccacucacagaucuaggucuuucacaaguucuggccuuugucuggaguggccuuca

SEQ ID NO: 4201986 - RNA, 58 nt, Human
uggcaggugcacuuuugguuucugugauuacagugaugagcaagaguguaccuggcca

SEQ ID NO: 4201987 - RNA, 60 nt, Human
uggcagguggacgugcuaaagcuugcagagaauucgugaagcacagcauauccaauguca

SEQ ID NO: 4201988 - RNA, 66 nt, Human
uggcagucuuucccuugagcucugcaaaugcagcaaaguacugagcucaaagggaagauucagcca

SEQ ID NO: 4201989 - RNA, 63 nt, Human
uggcaguggcccuaacaccguuucucaggauuccuuugaacgguaagugccauucaagagcca

SEQ ID NO: 4201990 - RNA, 62 nt, Human
uggcaguguugugccacauucccaccuugcaacaaucacguggaacugaguggcagcugcca

SEQ ID NO: 4201991 - RNA, 77 nt, Human
uggcaguucagguuggacucuuucgcgggccaggggcgggagaggccagucuuuuguaauguuugccugagcuacua

SEQ ID NO: 4201992 - RNA, 117 nt, Human
uggcaguugcuuauauucuuguauuuauuugcccacucaugcuuuugauaaauacacagggagugcuuaucaagugccaggugugguucuagguacugugaacacagcaacaaacca

SEQ ID NO: 4201993 - RNA, 74 nt, Human
uggcaguuucuuaagucacuggacuugccuagauuggauuuagcguaacacaugagcuuauuuggaaaaugcca

SEQ ID NO: 4201994 - RNA, 62 nt, Human
uggcauagguaucaaggauaaagcuguuuuauucauuucaacuaccuuugucaccaaugcca

SEQ ID NO: 4201995 - RNA, 95 nt, Human
uggcauauccgauucagaauggcaguguuuguguucucacauguggaacaggcuuuuuacaucaucagaagaaaugcugucaaaugguuaugcca

SEQ ID NO: 4201996 - RNA, 86 nt, Human
uggcaucccucagaaucagagcugaguagaggcaaacuggugcagaagcauuuccugugucucuauuuauguguucagggauucca

SEQ ID NO: 4201997 - RNA, 59 nt, Human
uggcaucuguguugcgguugucacuugguaacaagauaaguacuucgacagagguguua

SEQ ID NO: 4201998 - RNA, 67 nt, Human
uggcaugagggcauuuacagaaaugcuggcggaacugcugccagggaggcuguaggguccucuggca

SEQ ID NO: 4201999 - RNA, 74 nt, Human
uggcaugagguuuuaaucaucuccgaaaaaagaguagguaagcuuccugcuggaaaugaaagaacuaaauguca

SEQ ID NO: 4202000 - RNA, 64 nt, Human
uggcauguccucuguucuugcucugccuucuguuggcucagggacguuagaggacagguugcca

SEQ ID NO: 4202001 - RNA, 69 nt, Human
uggcauguggcuuugagucaucugauuggaugcauuccccucacauuuugaacccagagcucaugacca

SEQ ID NO: 4202002 - RNA, 94 nt, Human
uggcauuauuuucuuauuugaaaagaagguuacguuaaugaaauguuaguugauuguuacauuguuuucagauaacaugacuuuuguaauguua

SEQ ID NO: 4202003 - RNA, 72 nt, Human
uggcauucugcaaggggagaauuagaagcuaggugcugccaguugaaugaaucauucuauguauaugugcca

SEQ ID NO: 4202004 - RNA, 72 nt, Human
uggcauuguauucaguuacaggucuucuuuguagacuuuaaaaacacaagcuugccaagugaauacaagcca

SEQ ID NO: 4202005 - RNA, 65 nt, Human
uggcauuuagagaaaugaaggauuuaauuuccagcaaacgauucuuguuuccucccaaaaugcca

SEQ ID NO: 4202006 - RNA, 55 nt, Human
uggcauuuauuacuauugccgugggguuuccaugggccaguucuguugaaagcca

SEQ ID NO: 4202007 - RNA, 69 nt, Human
uggccaaagguacuuguuccugcaucuuccauacagcagguauauggucaggguuccagguaucuucca

SEQ ID NO: 4202008 - RNA, 63 nt, Human
uggccagcucagucuccaucagggauuuggguuuagucaccuuggagaccugggucugugcca

SEQ ID NO: 4202009 - RNA, 70 nt, Human
uggccaggauggucuucauuuggcucucccaccuuccugucauggagggcuaugaaaccauacuugggca

SEQ ID NO: 4202010 - RNA, 95 nt, Human
uggccaggccagucucgaacuccugaccucgugauccgcccaccucagccuccuaaagugcugggauuacaggcaugagccacugugccuggcca

SEQ ID NO: 4202011 - RNA, 75 nt, Human
uggccaggggcaguguaacaaccugaggauaucuggcaaaggucacucucaggaagugauauugagaccugacua

SEQ ID NO: 4202012 - RNA, 87 nt, Human
uggccaguuacgcagccucuccgagccacugccucucuguggaaggagggccugaggcugacggggagcagccgccucgcuuggcca

SEQ ID NO: 4202013 - RNA, 94 nt, Human
uggccaguucguuucuuaaacaucuauuuuaaaaggacuggguguugauacaguuuuuccaggguuagauguuuaugacuuuauggauuugucg

SEQ ID NO: 4202014 - RNA, 70 nt, Human
uggccaucaauugccacccagaccuugaagccacucugcuugucucuagggcaaugugaacuccuggcca

SEQ ID NO: 4202015 - RNA, 128 nt, Human
uggccaugagcagggcuggguauccugggcugugcagggaguggguuuggccuaggccccaaggagugggggccaggcgaugaccccuccacucuccaggacacccaugcucucugugcagugggcca

SEQ ID NO: 4202016 - RNA, 56 nt, Human
uggccaugggauagugcagggguguguggcaggcuagugucauuguccugaggccg

SEQ ID NO: 4202017 - RNA, 57 nt, Human
uggccauuccucacuauauuucacagggcacacgcugaugaaggagggggauggcca

SEQ ID NO: 4202018 - RNA, 71 nt, Human
uggcccacuucugagauuaagcagagauggaaauaaaacuuucccuuuccugacugaucucauuauagcca

SEQ ID NO: 4202019 - RNA, 91 nt, Human
uggcccagggagugucuggugcugugcaggacaaagggucaauccacaaauuugucccuuaccugauugcuggcauccaacacucaugcca

SEQ ID NO: 4202020 - RNA, 67 nt, Human
uucauucucauaaguguugcaguuaguauaagaaauuaugugcucacccuauuuauggaagagugaa

SEQ ID NO: 4202021 - RNA, 70 nt, Human
uucauucugggcucuaaggaacugggguggccgguugggcagguggguuucuuggggcccagaaucugaa

SEQ ID NO: 4202022 - RNA, 74 nt, Human
uucauugcaaacuccuggguuccggagauucugcuuuaauagguaggguugaggcccaggaauuugcacaugag

SEQ ID NO: 4202023 - RNA, 74 nt, Human
uucauugcagaauuuggccucaccaugcgugagucagaacaagcgccuugaaggccagggauuugcagccugag

SEQ ID NO: 4202024 - RNA, 67 nt, Human
uucauugcugcauuauuuagguuggccacaaaaagagagaccacaaucuaaauguccagcaauagaa

SEQ ID NO: 4202025 - RNA, 70 nt, Human
uucauuuaacagacguuuaccuagggccugcucugucuaaagucacaggcacuggggaugcugggaugaa

SEQ ID NO: 4202026 - RNA, 87 nt, Human
uucauuuacauucuuccucaaaugcaggucauaaccugaguuugagaugcagggaaugaccugcguuuuagagaagaggaaagugag

SEQ ID NO: 4202027 - RNA, 60 nt, Human
uucauuuauucagcagguauuuacugagcaccuucuaagugccaagccuguugaaaugaa

SEQ ID NO: 4202028 - RNA, 56 nt, Human
uucauuuauuguagucuuaguauucccaugggcagaacugagaccaauaaguagaa

SEQ ID NO: 4202029 - RNA, 80 nt, Human
uucauuucccagacagccaaugccugcagcccagugugcaucuuuucacauacugcugagcauuugcagggacagaugaa

SEQ ID NO: 4202030 - RNA, 98 nt, Human
uucauuucuagguauguuucuguguuggggugaggcauauccgccaauggcuccugagaaacggcuuccuucugaagcauagaagcaacuuauaugaa

SEQ ID NO: 4202031 - RNA, 92 nt, Human
uucauuucuguuuaaaguucuggaagcugcauaacuagcguggacugacugcugugucauugugcugugccuuugaacccuggcugagugag

SEQ ID NO: 4202032 - RNA, 62 nt, Human
uucauuuugagggaaccucuuacauaggacauccuauccaugcaagaguuucucaaacugga

SEQ ID NO: 4202033 - RNA, 77 nt, Human
uucauuuugguuggaauuaggcaggugguaccugaagcccuucuacauacauuuguucugauuucaaaaggaaugag

SEQ ID NO: 4202034 - RNA, 77 nt, Human
uucauuuuuccaaauuagaaguagagagggaaauuugagguaugaaauuaaaauagucucacuucuagaaagaugga

SEQ ID NO: 4202035 - RNA, 85 nt, Human
uuccaaaccugaaauauagaugugaacaguguguaccaguuuaacgcuuucacuucauuuguguuuuuuaauuaaggauuuagaa

SEQ ID NO: 4202036 - RNA, 80 nt, Human
uuccaacauggcucaugagagauuuggggauuuauuuaaccgccuuuauccaggcaaaucuccuagugaccuuguuggga

SEQ ID NO: 4202037 - RNA, 81 nt, Human
uuccaacuguuauucucaauaauucguguuucuuugguacaaagaguacuguaaaaugcaguugguggggauaugcuggag

SEQ ID NO: 4202038 - RNA, 55 nt, Human
uuccaagcauggucuacugcggggccugugcucuggcaguccccugugccuggaa

SEQ ID NO: 4202039 - RNA, 60 nt, Human
uuccaagugucagaucagauuuuuagacugaaguuucuaaagucugcacagauaccggaa

SEQ ID NO: 4202040 - RNA, 59 nt, Human
uuccaauauuuacaaugcauuaugaaguuauggaauucaggagugcuuaaguguuggaa

SEQ ID NO: 4202041 - RNA, 98 nt, Human
uuccaauuacacugcauuguaacaacauuugauuuuuagaaacuauugagcuuuggaauuccuguuguuucgucaguguuuguaaguaguuuauggaa

SEQ ID NO: 4202042 - RNA, 75 nt, Human
uuccaauuuggagaguaauuccaauauaaaucacuguuauggagugcuagguuguggauuacuacccuuuuggaa

SEQ ID NO: 4202043 - RNA, 92 nt, Human
uuccacagcaaccaacgcuggcugccaauuucagagcugccccugggccuggcucugcuggauugaggccaggagugccugggucugaggaa

SEQ ID NO: 4202044 - RNA, 66 nt, Human
uuccacagguguucuugcagugaaaaugaaaauuuuaaccugucaauuugcaugcuuuuugugggg

SEQ ID NO: 4202045 - RNA, 57 nt, Human
uuccacaucucucagcuuccagugcccagcacugugacccagagcaggugccaggaa

SEQ ID NO: 4202046 - RNA, 56 nt, Human
uuccacauuugaucaguguuuuacugugaagaucagugcugaaaucaaauuuggaa

SEQ ID NO: 4202047 - RNA, 73 nt, Human
uuccaccuccuggggcugaggucgccaagcgugcugcgugcagcugcugagcccuggcacaggugggcuggaa

SEQ ID NO: 4202048 - RNA, 66 nt, Human
uuccacuggcaaacugaagucacaaugucuuuucuguucguggugauuuccagugagucaguggga

SEQ ID NO: 4202049 - RNA, 79 nt, Human
uuccacugguaaauccaagaaguuucguuaaauguucucugugaggaccuuuuuaauucuuguauucuauucaguggga

SEQ ID NO: 4202050 - RNA, 56 nt, Human
uuccacugguauuugaaaauagauguuuaauauuuauuuagugguggcagugagaa

SEQ ID NO: 4202051 - RNA, 77 nt, Human
uuccacuuauaugaguuaucuaaaauagucaaauucauagaaucaaagaguuggauugugguuaccaguggguggag

SEQ ID NO: 4202052 - RNA, 57 nt, Human
uucuaccagcuacucacugauagguaaaguucaaugaguucauuuguggugguggaa

SEQ ID NO: 4202053 - RNA, 62 nt, Human
uucuagaacaggcaaaaccaaucaauagugacaaagccgaucacugguugccuggacugggg

SEQ ID NO: 4202054 - RNA, 104 nt, Human
uucuagacuuuuaaagcccaauucagcaauuauuuuaaggagaggucaaacaagcaggcugaagcuacaaaagauuauugcuguuuugguuaaagcagcuagga

SEQ ID NO: 4202055 - RNA, 58 nt, Human
uucuagauuuggggcaugaaguucugccacuaaggcauaaccaguacccaaguaggaa

SEQ ID NO: 4202056 - RNA, 80 nt, Human
uucuagcuaacgauuucuuucucuugauauuuuuuagagaaauaugaaacgcaaugggagcagaaauuguuugaauagga

SEQ ID NO: 4202057 - RNA, 57 nt, Human
uucuagcucauggugacagaucuguuucaagggucugucacagugcacagcuaagaa

SEQ ID NO: 4202058 - RNA, 58 nt, Human
uucuagcuguggucgagugaggaaaucaucaaaucaucuuccuuaaaagcagcuauaa

SEQ ID NO: 4202059 - RNA, 66 nt, Human
uucuaggggucagugaccauugaggauguggacacaaucuuuacuaagagguccuggcccagagga

SEQ ID NO: 4202060 - RNA, 79 nt, Human
uucuagguaaaauugcauucaggaugcaggaagguacaaaaauacuucuaggggauuuccuaaaugcgguuauugagaa

SEQ ID NO: 4202061 - RNA, 85 nt, Human
uucuaguauuguuugaaaccuuuauuuaaaagugaaaaugggauucaacuuauucaaaguagaugaaguuucaacacccauagaa

SEQ ID NO: 4202062 - RNA, 84 nt, Human
uucuagucuagucagcauauuacuuuaaaaaaucuucauagagaugccauuuuuggagagugugcauagggacaagacucagaa

SEQ ID NO: 4202063 - RNA, 77 nt, Human
uucuagucucucaauguaaauuugcugcccaauguuuauagguaaacacaugcagguauacauguuccagagaagaa

SEQ ID NO: 4202064 - RNA, 61 nt, Human
uucuaguuacucuuaaaugcugccuucacaagguuaauuuggcuguuaauagugauuagaa

SEQ ID NO: 4202065 - RNA, 76 nt, Human
uucuauaguccuuauuucacuuaaacguaugagguggcaugagccuuuacuuuagaaggaaauaaguucuacagag

SEQ ID NO: 4202066 - RNA, 88 nt, Human
uucuaucaggaaagcucuugcaucuguuguauuggucugacuuggaugacaugacuaacccaggaggcaagagauuccaaagauggga

SEQ ID NO: 4202067 - RNA, 65 nt, Human
uucuaucucuucugcucauguuaagguaugagguuacuuugcaaacacuuaagaagagagaugaa

SEQ ID NO: 4202068 - RNA, 60 nt, Human
uucuaugccugagaagaagccgcaaaaagagagagguuucugcauguuucagagcuggga

SEQ ID NO: 4202069 - RNA, 91 nt, Human
uucuaugggcgcuguauauuucaucgcaguucaucuuucauauccugggaaguaugucaaaaucugcaugauaugugucguguuauaagga

SEQ ID NO: 4202070 - RNA, 57 nt, Human
uucuauguaccuagcguuguaucuauuuccuaaggugcaaugaaugguaugcuggaa

SEQ ID NO: 4202071 - RNA, 69 nt, Human
uucuauguagagcaggacuugagauguuaugauaaauguauaauuucucaaaaguggucuacuugagaa

SEQ ID NO: 4202072 - RNA, 57 nt, Human
uucuaugugcuggagaauauuuuuaugccauuuaaaaauaaacugaagcacagagag

SEQ ID NO: 4202073 - RNA, 57 nt, Human
uucucaaagaaagcugucauuacucucuguaauuuuucaaugaguuuucuuugagag

SEQ ID NO: 4202074 - RNA, 64 nt, Human
uucucaauuccacuucauugacaucaaguuaguagcuugaaaucagccauggugagagugagag

SEQ ID NO: 4202075 - RNA, 59 nt, Human
uucucacaauucuuguauuugcuaaaccaugaguuuagggaagauuccaauugggagaa

SEQ ID NO: 4202076 - RNA, 67 nt, Human
uucucacagcucuggaggcagggaaguccaagaucagggcaucagcagauucagagucuggugagga

SEQ ID NO: 4202077 - RNA, 66 nt, Human
uucucacauucacagaauggcaaguuauggucuaacugugcuuugccuggugugaaauagugggaa

SEQ ID NO: 4202078 - RNA, 66 nt, Human
uucucaccccuguggagcaugguggccagcaccaacgugggcacuguggaggcauggggaggagaa

SEQ ID NO: 4202079 - RNA, 55 nt, Human
uucucacuauauaguaagcuccaggaaaugaacagagcuugcaguguguggagaa

SEQ ID NO: 4202080 - RNA, 65 nt, Human
uucucacugccuuuggugggaacacucugucaacagcaguggcugaagcaucaaaggcaagagga

SEQ ID NO: 4202081 - RNA, 129 nt, Human
uucucagaauuacuaucuaggauauagacagagcagagaaauccaaaucuucacacauaacauacccacuuacuuauaucuuaucaucuaggcuuggguuuuuuugccuagguagaauauuuuucagag

SEQ ID NO: 4202082 - RNA, 91 nt, Human
uucucagagcugccagaaacaucaucugaggguuugggcaucagcucugccuggcugguguucaggcccucagucacuuuggaagugagaa

SEQ ID NO: 4202083 - RNA, 63 nt, Human
uucucagauauuuguauggaacucuuagacaucagaaagagcuacaacgaagguaucugagga

SEQ ID NO: 4202084 - RNA, 69 nt, Human
uucucagccuacuucauuaucaagcuauacuauuuuauuuaugcaguuugaugaucuuacggcagagga

SEQ ID NO: 4202085 - RNA, 74 nt, Human
uucucagccucugcuugggcuccuagcuccaggaggggggucagugacaugcucucaggcauaaaggcugagaa

SEQ ID NO: 4202086 - RNA, 63 nt, Human
uucucagcugaguccuaccaauaaagaucuacucuucauuugaguacaaacucagccugagag

SEQ ID NO: 4202087 - RNA, 91 nt, Human
uucucagguuggcucuguuccuauguuugggcagacauuaauuuaaucagagcuagaaucugccugcagcaaagacucagcagcuugggaa

SEQ ID NO: 4202088 - RNA, 62 nt, Human
uucucauccuucagugcaguuaaucgcuacacaagaugacgcugccugucccaggaugagga

SEQ ID NO: 4202089 - RNA, 55 nt, Human
uucucaugucccaguaaagcuuggaaacaacaucacuaucacugggcacugagga

SEQ ID NO: 4202090 - RNA, 56 nt, Human
uucucauucugacucaguguaggccacaccauuugcaagccuguuuagaaugagag

SEQ ID NO: 4202091 - RNA, 62 nt, Human
uucuccagacccuccugcagacccugauaggucaggaccuccugcacugggggcucugggag

SEQ ID NO: 4202092 - RNA, 104 nt, Human
uucuccaugggacaguuaaauaaugcaagcauggaauacuccaggaugucaaaguggauagagaucagugugaguaccaugcucagggaugacuccauggugaa

SEQ ID NO: 4202093 - RNA, 68 nt, Human
uucucccucucaguucuugcuuaggcaacucucugcaguccccuuggcaguggagugaggugggagag

SEQ ID NO: 4202094 - RNA, 62 nt, Human
uucucccuuuuagcuuccagucggguugcccagugggcagugcuggaggcuggagggaagga

SEQ ID NO: 4202095 - RNA, 67 nt, Human
uucuccgaggcacccugagguucacuuccagacacagaugucuuuuauuucauggugcuuuuaagaa

SEQ ID NO: 4202096 - RNA, 68 nt, Human
uucuccggguggcggcgaagggaccgccgcucauccugccugcaucccuccgccgccugccuggagaa

SEQ ID NO: 4202097 - RNA, 79 nt, Human
uucuccuagaauugcauucuaugaauauaauauuuuguugaguaguuagucaaauuaaaugcaguuuucaaaaggggaa

SEQ ID NO: 4202098 - RNA, 71 nt, Human
uucuccugagcaggcagccuaggaagugaagaaccaaagccucuguauagccugagcugcuugccagggaa

SEQ ID NO: 4202099 - RNA, 60 nt, Human
uucuccugaguguguuaaaacaaaacucuauuaccuuugucaacaaaacuuucaggagaa

SEQ ID NO: 4202100 - RNA, 66 nt, Human
uucucuaaacucuaguaaaauguauucaggcaggaccucaaucaauaacccuggaguugaagagaa

SEQ ID NO: 4202101 - RNA, 60 nt, Human
uucucuaaagaguuaggccaagauguauuugacacauaauaugcuagacauuuuggagaa

SEQ ID NO: 4202102 - RNA, 117 nt, Human
uucucuaaauuaacccucccagcagcacuugagagaggauuguuauucccauuuuauaaauuagaggggagaggugagcaacuucugucaaggucacacugccaaugaguagcagaa

SEQ ID NO: 4202103 - RNA, 71 nt, Human
uucucuaagagaugcagaaguuaaguaaauaaaccaguacgauacagagcugucauuucuauuauagagga

SEQ ID NO: 4202104 - RNA, 64 nt, Human
uucucuaagcuggcugaggucuaugaccccagauuggguccuggccuggacaccagcaagagga

SEQ ID NO: 4202105 - RNA, 74 nt, Human
uucucuagaggagggaugugguuguugggugaugcucucagagcacaagaauaaccauauuuaaucucagugga

SEQ ID NO: 4202106 - RNA, 73 nt, Human
uucucuauacuugaggcccaggaauacacagaaauaugagauccucagggguuucagguguacaugaagagaa

SEQ ID NO: 4202107 - RNA, 63 nt, Human
uucucuauggcaucaggggaugaagcuggucugcaggaagcugccauccgaggugucagagaa

SEQ ID NO: 4202108 - RNA, 82 nt, Human
uucucucuccgguacuuuaagacuccaguagcaaaucuuaauguugugcuuugggugugaaguguuugcugcaguaagagga

SEQ ID NO: 4202109 - RNA, 75 nt, Human
uucucucugcuccaaaguggggcugaccaacuagguuggugaccuggcugcuuucacuauggaguucuaggagga

SEQ ID NO: 4202110 - RNA, 97 nt, Human
uucucucuguguauguguguguguguguguguguguguggguguggguguggguguacacaaggacauguauauuuaugacuauauggaggagggag

SEQ ID NO: 4202111 - RNA, 129 nt, Human
uucucucuugucaaugcugaugacauccaugaauccagcaggguagguuguaucaguucaaaccuugccaucgaucuuaaugaacugcugcaugcaaaucuucuuuacuucaucuccugucagggcaua

SEQ ID NO: 4202112 - RNA, 129 nt, Human
uucucaacuagggacauguacuggggucaccugcagagcuuuucaaaauacaucugcuagggccauggccugggacugcauauuuugacgauuuuaugcaaaugauucuuaugcauaccuaauugagaa

SEQ ID NO: 4202113 - RNA, 69 nt, Human
uucucaagugagauggcccuggcauguagcucagauuccucagcuaaacagggccgucuccucugagga

SEQ ID NO: 4202114 - RNA, 59 nt, Human
uucucaauggcaacuuguugcuuggauucucaucagaagcaaauaauugucuuugaggg

SEQ ID NO: 4202115 - RNA, 69 nt, Human
uucucaauuugagaggcaugucuauuauuuagaaaauucugguuuagauuccucuacaauaaaugagaa

SEQ ID NO: 4202116 - RNA, 80 nt, Human
uucucacagggcagcaaguggugggagacuuugaccuagaccccuaaagcuuaucuugcauauuuguuaaucauguggaa

SEQ ID NO: 4202117 - RNA, 81 nt, Human
uucucaccucgucuucccuuguuccucccucaauucucagauccaccagugagacagaaaacauaggagacaggaaaagaa

SEQ ID NO: 4202118 - RNA, 68 nt, Human
uucucacggcuggguucugagaaagaguaauucaauagcaugcauuucaaaagauccagcugguagga

SEQ ID NO: 4202119 - RNA, 98 nt, Human
uucucacugauauuucuccaaugcuuaggaaaguuugagguguauucauaagcucugccaaacuuuuuuagguucauaggcauaaucuuuaguaugaa

SEQ ID NO: 4202120 - RNA, 57 nt, Human
uucucagcccugaugaguaggcaauacuucuaagggugcugcuccaggagcugggga

SEQ ID NO: 4202121 - RNA, 93 nt, Human
uucucagccuccagaacuguaagaaauaaaauucuguuauuuauaagguauccaguuuauuuauuuguuauagcagccuggacagacugagaa

SEQ ID NO: 4202122 - RNA, 55 nt, Human
uucucaggaacucagugucagcuaucacaauaggcuggcaguggcuuccugagaa

SEQ ID NO: 4202123 - RNA, 57 nt, Human
uucucaggccccugccuggacuugcugaaucagaaacucuagggguggggcccagaa

SEQ ID NO: 4202124 - RNA, 68 nt, Human
uucucagggcaucucaugacccuuagagcaguguuugcagucugggugcacauuggagucacugggga

SEQ ID NO: 4202125 - RNA, 62 nt, Human
uucucagggcccuguguuagcuggcuucuagcugaguuuggcuaaugggaggcucugguggg

SEQ ID NO: 4202126 - RNA, 56 nt, Human
uucucaggguuggccucaaaucacuagacagaguccuugaauguuaguucugggga

SEQ ID NO: 4202127 - RNA, 58 nt, Human
uucucaguaugugacgaggaccaucaaaugaugauguucuacucuuaccaugcuagaa

SEQ ID NO: 4202128 - RNA, 84 nt, Human
uucugagcuuacuucuguacacagaugccaccaaugucaaguucuccaugauaauagccucuguguggggagguagagugugaa

SEQ ID NO: 4202129 - RNA, 57 nt, Human
uucugaggaugcagccaccuuccuauggugaguggagauggcugguuguccucugaa

SEQ ID NO: 4202130 - RNA, 130 nt, Human
uucugaugaagucuucuaucucagauuaaagacagucacuuuuucacuguguccucacacugcuuuuccucagugcacgugugcagagagagugaaagagaaagcucucugugucucuucuuaaaaggaa

SEQ ID NO: 4202131 - RNA, 63 nt, Human
uucugauucauucucaguuucuagaggaaaguauuuauuuucuaaggaugagacugaacagaa

SEQ ID NO: 4202132 - RNA, 103 nt, Human
uucugauugaugggccaucaguugcacaguuguugggcagugauugauuuuccaacccagcugcuccagcugugcugcagaugcgccuugucugaagucagag

SEQ ID NO: 4202133 - RNA, 67 nt, Human
uucugcaaaacucucccaagugcccuaugaugugccaguuagugucuuaggcacuggugaugcagag

SEQ ID NO: 4202134 - RNA, 85 nt, Human
uucugcagauugacaaagcccaucuuucugcuaaugacuuuagagucaaauaugagacagaacuggccuuucaucagucugugaa

SEQ ID NO: 4202135 - RNA, 78 nt, Human
uucugcagcaucauaucuucagugaagggaggcagguagaugcugcucccagaaaaaggaggcuaugaacuagcagaa

SEQ ID NO: 4202136 - RNA, 129 nt, Human
uucugcaugccccuuugggagauuugaagaugaggguuucaaugggaugaauguuaagcucugggucaagugggcccuggauuuacaucauucugacuucacaagucucugaggaaaaaagugcauuua

SEQ ID NO: 4202137 - RNA, 91 nt, Human
uucugcccuuacuuagcacgaacauuuacuuuccaaacaauuuacccaagugaggaaaugauuaaauauguuuauaugcuaaggggaagaa

SEQ ID NO: 4202138 - RNA, 58 nt, Human
uucugccugauguagucauaccucagaucccucuaggcagagcugcauucauguagaa

SEQ ID NO: 4202139 - RNA, 73 nt, Human
uucugcugcacuugagccugggagaaguuggcuccagaaauuuugccaucuaucuugccaucaaucgguagaa

SEQ ID NO: 4202140 - RNA, 65 nt, Human
uucugcugccuacuccuggggacuugaagguugaguuagaguccacccuaccuagacaguaagaa

SEQ ID NO: 4202141 - RNA, 58 nt, Human
uucugcuguacagaaaugcuucucucccagaauugaagcuucuaucucugcagaagga

SEQ ID NO: 4202142 - RNA, 115 nt, Human
uucugcuucuguuucuucacugugcuguagaggaaaucucacaagccgguaugggucagugaugcacuggccuaagauuguguuuuccugacagucagugguuaaauaugcagaa

SEQ ID NO: 4202143 - RNA, 129 nt, Human
uucuggaccagauauuguuuuuuaauuuucaauguuuauucuaggaaaacuccuuagcucauaaaagauuuaguguuaagagaaaauucugcuuugagagcuuugaaaaauauuuauuauuauccagaa

SEQ ID NO: 4202144 - RNA, 94 nt, Human
uucuggagccugcagagacaagggaucgucuugcaagcagagagagcagcccuccucagccagugccuugaucuugccuucccagccuucagaa

SEQ ID NO: 4202145 - RNA, 56 nt, Human
uucuggaguauuccuggcaccucccaucucccaaggcugccaggaauacuccagaa

SEQ ID NO: 4202146 - RNA, 56 nt, Human
uucuggaguauuccuggcagccuugggagaugggaggugccaggaauacuccagaa

SEQ ID NO: 4202147 - RNA, 65 nt, Human
uucuggccaccggucugguuugaauauaaacagugccuuucauuacaggcaguuugugguuaggg

SEQ ID NO: 4202148 - RNA, 74 nt, Human
uucuggccuaagguacagaauucugucccuugaguggacacugggaagagagaauucugucacuauccccagag

SEQ ID NO: 4202149 - RNA, 112 nt, Human
uucuggccugggguuaagccaguccucccucaccucagucugggccucaucaugccccucgcacaugacccagacccagagggaggcagguugcccuacccauuuuccagag

SEQ ID NO: 4202150 - RNA, 61 nt, Human
uucuggcuccacucugugcaugcuggaggacaauuuacagcagucaguaaggcagccagaa

SEQ ID NO: 4202151 - RNA, 75 nt, Human
uucuggcuccagaugcuucuguuagaaaugguaagaaauauacauuuaaauauauuugguuuuuggagauuaggg

SEQ ID NO: 4202152 - RNA, 57 nt, Human
uucuggcugggcagacagaaugcuuucaauuuagaccauggagcucccagcucagga

SEQ ID NO: 4202153 - RNA, 88 nt, Human
uucugggcagcacaagguauguuuuguuuggugucugguguguuaauacuaggaggcauauaaaacauucauuuaucugcugucagaa

SEQ ID NO: 4202154 - RNA, 68 nt, Human
uucugguaaaauguuacaugcucccacuuaggaccucuuuuuggauucaugcaggauuuaaccuagaa

SEQ ID NO: 4202155 - RNA, 117 nt, Human
uucuggugaaggaagugcucagggaacauuuacaguaaucgaguguuguggcagcaauaucccaugucacaguauagaguuauuuuggcaguuucgugagccuuucauuccucugaa

SEQ ID NO: 4202156 - RNA, 86 nt, Human
uucuguaaagccauagccaugcugcuaugcacagccaugcaauuugcacacugugacaaaagcagccugccuggggacagauagag

SEQ ID NO: 4202157 - RNA, 116 nt, Human
uucuguccuacccuccuacugcagaaagcucacuuccuggcagugcccagucacuguuccuagagcagcccuagggauugcuguuuucugcuaucuguggaagcccaaggacagaa

SEQ ID NO: 4202158 - RNA, 60 nt, Human
uucugucguguucacuguggccuaggacauugccuggccaacaguaggagcucgauugaa

SEQ ID NO: 4202159 - RNA, 56 nt, Human
uucugugaaacuaaagagaggaugauuaauucagccuagauguaggauucacagag

SEQ ID NO: 4202160 - RNA, 96 nt, Human
uucugugaauauuuuuguccguauguauaugaagcuaguauuuuuguguggagaguauuaaauuuacauugacagagagauuugaaguaagcagaa

SEQ ID NO: 4202161 - RNA, 97 nt, Human
uucugugaggacuauagaagggugugagacuguuauugcaauaguucacauuggugaugacagcauuuucuucuaaggagauagucagggagcaggg

SEQ ID NO: 4202162 - RNA, 68 nt, Human
uucuguggaaauugucagcuucuuucaguagaaaguccugcacuggaagccaguugacaaucacagaa

SEQ ID NO: 4202163 - RNA, 87 nt, Human
uucugugggcucaggagucagaggcauacucccagucuugcuuacaauugcagaaagguaugugugccuuuggcugugcccacagaa

SEQ ID NO: 4202164 - RNA, 130 nt, Human
uucugugucuuaccugaucuaugcaaucauucuuggauuuggcucuagugaaaaaugcaacguaaaguuaauuugaaauacucaagcugcaaucuaugaacuauucuuuacaagggacaagcccacagag

SEQ ID NO: 4202165 - RNA, 127 nt, Human
uucuguuaauguuacuuuucagcuuuaggggauucuaaguugggaugauuugaacuuauucaaauaaauccaaaucaucccaacugagaauccccuaaaggugaaauguugaaugugacauucagag

SEQ ID NO: 4202166 - RNA, 57 nt, Human
uucuguuagcauucugaucuccuucuuugggggauuucacacagaguguaaacagga

SEQ ID NO: 4202167 - RNA, 56 nt, Human
uucuguuaucauuaagcauuauuugacuugcaaaugucaguuauguuguaacagaa

SEQ ID NO: 4202168 - RNA, 65 nt, Human
uucuguuccuacuaccuggcugucauguuaccaacugaagcuauugguaaggaagugggaaagaa

SEQ ID NO: 4202169 - RNA, 67 nt, Human
uucuguugacauguuuauuggagauuggauuucuaagagaucauuuucacauuaauguuuagcagga

SEQ ID NO: 4202170 - RNA, 80 nt, Human
uucuguuucuguuuugggagggguguaugugagagaguuuuccuuccaugccuuacucuucaccgcuacugaaauacgaa

SEQ ID NO: 4202171 - RNA, 66 nt, Human
uucuguuucuucucgacaccuuaucccucgguucccgcuggggagaacacaugaguggaaacagga

SEQ ID NO: 4202172 - RNA, 66 nt, Human
uucuguuuggagucauccuaaugccuccagaagccugggagggcucaauugacuccugaggcagaa

SEQ ID NO: 4202173 - RNA, 60 nt, Human
uucuguuuucguagcagauugcaaaagcucugugugcuuagcauguguauggaaggggga

SEQ ID NO: 4202174 - RNA, 99 nt, Human
uuagcacaguuucugacauggaaaguacuccacaauuauuaacuauauuuaauuugacauauuuaugaagcauuuucuauguccugggagguguguuaa

SEQ ID NO: 4202175 - RNA, 72 nt, Human
uuagcacuuugauucaugcagauuaugugaaguuguuuccccuuuuguccugcauauauaaucauaggcuga

SEQ ID NO: 4202176 - RNA, 115 nt, Human
uuagccagguaugguggugcaggccuauaaucucagcuacuugggaggcugaggcacaagaaucgcuugagcugcagugagcugagauggugccacugcacuccagccuggguga

SEQ ID NO: 4202177 - RNA, 72 nt, Human
uuagcccuauucuaaguccuguaagauaaaauuuauauaauguacaagaggcuagggugagugcagggcuga

SEQ ID NO: 4202178 - RNA, 62 nt, Human
uuagccuuagaagcuuagcaaauggcuuuaaauauguuuuaauuugagcuuugaaggucuga

SEQ ID NO: 4202179 - RNA, 86 nt, Human
uuagcgcuuggcugccagcuuuuagugggcuuauuacuuccuuaaagagaaauagagagcuguuugaaagcaggcacaggaacuag

SEQ ID NO: 4202180 - RNA, 79 nt, Human
uuagcuacaucuugaagguucuaccauacauguucaucacuaaggcugcuguaugguagggguuuugagcuguuaauga

SEQ ID NO: 4202181 - RNA, 82 nt, Human
uuagcucaucaugcaguuuugccaccuaagagauuucuuuuacucccucucuuaagugucugucugacugcauuuguucuaa

SEQ ID NO: 4202182 - RNA, 129 nt, Human
uuagcuguuuuuuuuucaauuuaguacacccaagcauaaucaguaguagauuuauuagaugaccaaagaaguuuuaaaaaaugaugcucacagauuagugguggauucaaacaagguggaaacaaauga

SEQ ID NO: 4202183 - RNA, 57 nt, Human
uuagcuuguggugguacauuaggacuaaauauuccaaaugcauuaacauaaagcuga

SEQ ID NO: 4202184 - RNA, 66 nt, Human
uuaggaagaauauauuuagagcauggaagucuauuaacuuuuccucauuuuaaauguucuuuuuaa

SEQ ID NO: 4202185 - RNA, 63 nt, Human
uuaggaaggcacugggugccaaagucugucuuugaggucaggaucugcgccugugccuccuaa

SEQ ID NO: 4202186 - RNA, 75 nt, Human
uuaggaauuguuuucacuuguggaagcugagaaacagagauauucugagacuccauaaguugaaagauguucuga

SEQ ID NO: 4202187 - RNA, 107 nt, Human
uuaggacaguguuuaucucugggaagaaggucuuucuacauuuuauaugcuugcacuuucuuuggauaacauaguuguggaaaggaaacuuuucaguauugucuugg

SEQ ID NO: 4202188 - RNA, 57 nt, Human
uuaggagaucagagaggacucagucccauacucuguuuuguuucugcuauuuucuaa

SEQ ID NO: 4202189 - RNA, 60 nt, Human
uuaggaggaaaauuugagucacacaaaacaucucuuguagcauucauuuuugccuucuaa

SEQ ID NO: 4202190 - RNA, 56 nt, Human
uuaggccuaguuacugcuuacuucugaggcuugaggaguacagaauugggaccuaa

SEQ ID NO: 4202191 - RNA, 76 nt, Human
uuaggcuagcccuuaaauucuuaaugcccucauuuauaaagugagcauaacaacagaguuuagcucguugggcuga

SEQ ID NO: 4202192 - RNA, 64 nt, Human
uuaggguaacauguguguuauggauugaauuggguccucucaaauucacauguugaaguccuaa

SEQ ID NO: 4202193 - RNA, 67 nt, Human
uuaggguuuuucaaguaaugcuacuccuaugacuacuggguccuaggguaaauguauuugaaccuga

SEQ ID NO: 4202194 - RNA, 75 nt, Human
uuagguacuuaagaucucagcuaugcaaugagggucagcaacacuaaauguuagcagggauacaaggucgccuaa

SEQ ID NO: 4202195 - RNA, 78 nt, Human
uuagguauaacaucucauggacuacauucugcuucaauagaacuugcaggaaaauagacuugagaugguugcacuuag

SEQ ID NO: 4202196 - RNA, 79 nt, Human
uuagguugacgcaaaagcaauugugguuuuugucauuacuuucaaugcaaaaacugcaauugcuuuugcaccaacuuaa

SEQ ID NO: 4202197 - RNA, 80 nt, Human
uuagguuggugcaaauguaauugcaguuuucgacauuacuuuuaauggcaaaaaccacaguaacuuuugcaccaaccuaa

SEQ ID NO: 4202198 - RNA, 81 nt, Human
uuagguuugcuuacuucaguguuuuggacugugcugacauagagagucuacacacaaguuugggucacucagcuaacuuaa

SEQ ID NO: 4202199 - RNA, 65 nt, Human
uuauucacacaugaaucccuaguaccugcuauauaguaggugcucaaucauuauguaaugaauga

SEQ ID NO: 4202200 - RNA, 77 nt, Human
uuauucaccugaaucuuggacuucagaauagcaagcuaaggcuacuuugaagucaaagauugauuccaggaggguaa

SEQ ID NO: 4202201 - RNA, 63 nt, Human
uuauuccuuuuucugucugauuggauuagccaggacuuccaguacaauguugaaaaggaguga

SEQ ID NO: 4202202 - RNA, 87 nt, Human
uuauucuccuuaugccugaaaugucugaaagccaaucugcacugugaaggauggagauggcagagguuaugggcauaauggaaauaa

SEQ ID NO: 4202203 - RNA, 64 nt, Human
uuauucugaacuagacucucaucgcucucccaucucagaaaauguccaguuuacuucaggauga

SEQ ID NO: 4202204 - RNA, 75 nt, Human
uuauugaaaaggucacugaucaguugaguacagaugaaagguucuuagaguagaucaaugaccuguuguuaguga

SEQ ID NO: 4202205 - RNA, 77 nt, Human
uuauugcaccaugccucaguuucuacaguuguucaaagaaaauccacugcugauugggacuggcagggcugcggugg

SEQ ID NO: 4202206 - RNA, 56 nt, Human
uuauuguauuugauuaauuuuuuagauuuuuaaaaaagacuagucgagugcaguag

SEQ ID NO: 4202207 - RNA, 83 nt, Human
uuauuguguggaugcaugagugugugugagcacuuacauaucuggauguccaguuucuacacacauacaaguacacagaaugg

SEQ ID NO: 4202208 - RNA, 90 nt, Human
uuauuuaauccucacaacaaucucgugaaauggcuuugaucauuacuacuuuacagaugacagaacugggggcacagauaggauaaguaa

SEQ ID NO: 4202209 - RNA, 69 nt, Human
uuauuuaauuuucucacucagaggacaccugcuggcaaggaguaaacugauuugagcagaauaaaauag

SEQ ID NO: 4202210 - RNA, 68 nt, Human
uuauuuaggagaaggaacccuguuaacugagaaaauuaguauuguaagguucauuucuucccagauaa

SEQ ID NO: 4202211 - RNA, 84 nt, Human
uuauuuauaaugcagcccucaggaaccacauugcugcuuccauuggaguagggcuggggcuccugaagcuaacaucuugaauga

SEQ ID NO: 4202212 - RNA, 129 nt, Human
uuauuuauuauaguucauucauugugacaauguaccauaguaguaaaagaugcucuaaaaauuugaaaaagaaucuuuccucauugcugucaaguaucaugaugaaucuaaaaauuguaguuacaccua

SEQ ID NO: 4202213 - RNA, 86 nt, Human
uuauuuccaugagaucuucuagcagaaguaauuucggguuggugucuaucugaaagccuucugucuagcagauagcauugaagugg

SEQ ID NO: 4202214 - RNA, 59 nt, Human
uuauuuccuaaaucucuuuguuggguuaaguccauucugauauaagagaaguggaauga

SEQ ID NO: 4202215 - RNA, 56 nt, Human
uuauuucugagacuaaauucuuuaaauauaaauuauagaagucagcucagaaguga

SEQ ID NO: 4202216 - RNA, 69 nt, Human
uuauuugaggagaaugcgcaccacauauauguuucuuuuaauguaguagugguauuauuccuggaauaa

SEQ ID NO: 4202217 - RNA, 82 nt, Human
uuauuugagggcugugagggcuucugaggcauuggcgaaagcucugaugcaaagauuagaaaguuucacagcaugcauuuga

SEQ ID NO: 4202218 - RNA, 130 nt, Human
uuauuuguaaacauuuuuaaagauauuauucagaugagcauuggaacuuagguaaaauuuucaaaauugauauuuaacuggucccaauauauuuuuugaauuagaguauauauacaucacugacucuuaa

SEQ ID NO: 4202219 - RNA, 59 nt, Human
uuauuuguuuuccaucugggacuggcauucagagacccagagagguaaaacagccuuga

SEQ ID NO: 4202220 - RNA, 61 nt, Human
uuauuuuacuguuucccugcucucaagugcuuaagcauagacaggugaaacagcaagguaa

SEQ ID NO: 4202221 - RNA, 85 nt, Human
uuauuuuaggugguagaacaggguagagucaugucauuauuugcugguggaagacacuauuuaccagguguucuuugcugaauaa

SEQ ID NO: 4202222 - RNA, 59 nt, Human
uuauuuuagugauagaaaaaacuguggcugaaccaaguuuucugggaucacuggaauga

SEQ ID NO: 4202223 - RNA, 73 nt, Human
uuauuuucauagucauuuuuggcuggugaaaauuuuauuucacucauuugcaugaugugcuauguuaaaauaa

SEQ ID NO: 4202224 - RNA, 90 nt, Human
uuauuuucugucuuccuuccuagagcauaaacuccguuaagaucauucugaauguuucguaaauugucuaugggaggagagaggaaguaa

SEQ ID NO: 4202225 - RNA, 84 nt, Human
uuauuuuuguuauacaaagucacauugaaaugaaauggauacaugcaccauugacuuuaauaggauuuugcauuguaagaauaa

SEQ ID NO: 4202226 - RNA, 69 nt, Human
uucaaaaagauagcauugugcuccuuucuugguggagugaacaggugaggauuauacugucuuuaugga

SEQ ID NO: 4202227 - RNA, 59 nt, Human
uucaaaaagguauguucaaguccugacccccaguaccucugaauaugaccuuauuugga

SEQ ID NO: 4202228 - RNA, 83 nt, Human
uucaaaaguaguuuucaaagucaaugagauuguuuaaaagaguagguaccugacagucucuugcuugaauacuaucuagugag

SEQ ID NO: 4202229 - RNA, 76 nt, Human
uucaaaaucauugaguaaaaugaauacaauauuuaguuuaaauguauuguaaguuuuauuuacuagugagguugaa

SEQ ID NO: 4202230 - RNA, 94 nt, Human
uucaaaggacuuggacuggcagauaaacaugugauaaacagauaaaacaccucacuguccguccaucuuuuuaucguuggcaggugcucuugaa

SEQ ID NO: 4202231 - RNA, 88 nt, Human
uucaaaguagcauuuaguuugaaugauuucuucuucauccccugcuugguaugaaacagugaauuagucaaguaaaaaugucuuugga

SEQ ID NO: 4202232 - RNA, 57 nt, Human
ugggggcuccaggcuccagggaacuuuccuacauuaggagcuggggagcuggcccca

SEQ ID NO: 4202233 - RNA, 65 nt, Human
uggggggauaggagggagcacuauauggggagcaucagccugagcucugcucuugccuccccuca

SEQ ID NO: 4202234 - RNA, 77 nt, Human
uggggguagggauaaacagaguaguugcuacuggccucuagugggugguggccagagaugcuguuaaauaccccaca

SEQ ID NO: 4202235 - RNA, 80 nt, Human
ugggggugaggaaaagggcagaguucacuagaaagaaguaauaguccuucuguuacugaaagcugcccucucaaaaucca

SEQ ID NO: 4202236 - RNA, 80 nt, Human
ugggguaccaugugauguguugauuuaugcauauaauuugaaauaauuaaacugagcaaauuaacauauccaucaccuca

SEQ ID NO: 4202237 - RNA, 59 nt, Human
ugggguagguaugaaaacuaggguaauaagaugcuugauuguuuucagguuugccacca

SEQ ID NO: 4202238 - RNA, 74 nt, Human
uggggucacacugccugcucauaacauugcuauguggcuugagugacagcaggagagcagugcgugguccccca

SEQ ID NO: 4202239 - RNA, 79 nt, Human
uggggucaguaggaaccuagggucaaaaaaugggauacagucucccccuuuaugcaguugaucuuuucuugcugcccca

SEQ ID NO: 4202240 - RNA, 55 nt, Human
ugggguccugagcuagaaaauugaacuccuaguccaguuuucagcagaacaccca

SEQ ID NO: 4202241 - RNA, 60 nt, Human
uggggugggguuggggggcaaccacacuagauggugacauugcugcccucccuuuccuca

SEQ ID NO: 4202242 - RNA, 64 nt, Human
uggggugguguuugucucauaucagccuaucuuuucugccauugagauaauaaacaucuccuua

SEQ ID NO: 4202243 - RNA, 85 nt, Human
uggggugucgggaugggggugcugggagacacagaccugauacaguaugucuuucugcaccaccucacaauuuuccugaacccca

SEQ ID NO: 4202244 - RNA, 58 nt, Human
ugggguuccaaagcaaaggaggugagcccaucucagcucagagacuuuggaacaucca

SEQ ID NO: 4202245 - RNA, 82 nt, Human
ugggguuuuguuuguuuugggguuacggcaaacugaagaggugccaguuuguaaaauguggccuggaaauuaacuugccuca

SEQ ID NO: 4202246 - RNA, 93 nt, Human
uggguaaauggaggucaugauauucucuuuauuuuuguauagguuugaaauuuuacguaauauaagaaaguguggugaauagauauauacuua

SEQ ID NO: 4202247 - RNA, 64 nt, Human
uggguacagcuuggcgaauguagguauggacaagugagucugugugggcuaacaagcguaccca

SEQ ID NO: 4202248 - RNA, 57 nt, Human
uggguacuguggcauagccuuggcuccccuagucuaggcucugacccaugggaccca

SEQ ID NO: 4202249 - RNA, 130 nt, Human
uggguagacagacaggaagagaucaacauaguggguuuggcauacugacucaaauguaacuuuugcagacuggcucagugucaucacuuaauauaaaaugaucuucuuuauuguucuccaacccuuugca

SEQ ID NO: 4202250 - RNA, 56 nt, Human
uggguaguacgaggguuuguuucagauuccuugaaucagagcccugagucugcaca

SEQ ID NO: 4202251 - RNA, 128 nt, Human
ugggucacugugaccuuaaccugggcugguuuaaggcaugaguggguuuuagugaucgcccuucuguugggugaaguccacaggcugaggcccuucugcugcagcagccucguuagcaugauggccca

SEQ ID NO: 4202252 - RNA, 97 nt, Human
ugggucagaugaccuuguuagcgacuugacagacauguccuggaugcucuuuguucccaggaggcucucagguccucccccaggguccugucacuca

SEQ ID NO: 4202253 - RNA, 110 nt, Human
ugggucaggguaaguugcuggacagugggcagaggagacagguacuggcugagugaagcucagggcaaguuugacucuuccacugucucagccuccagacgaaugaccca

SEQ ID NO: 4202254 - RNA, 86 nt, Human
ugggucggguguggguucugcagaccaggugcggauucuguguagguucugcaggcccaguguagaggcucacaccuguaauccca

SEQ ID NO: 4202255 - RNA, 81 nt, Human
ugggucgguuagaaucacaugccagaacuuguaccaaucacugaagcuagagaaauggaguacugugcuguaauugaccca

SEQ ID NO: 4202256 - RNA, 97 nt, Human
ugggucugaaacacuucuuuaccaagagauagaguccucacugccugugcaagauucaucaccuugaguggaaguaucauuuccuguuucagacuca

SEQ ID NO: 4202257 - RNA, 66 nt, Human
ugggucuuaacaguguggaagagauuuuagggaaggacucuaacuugaacucaugacugugacuua

SEQ ID NO: 4202258 - RNA, 68 nt, Human
ugggucuugacuuccagccuucaaaucugaauagcauaucagaaaagaaguuugggauucaguuucca

SEQ ID NO: 4202259 - RNA, 60 nt, Human
ugggugaagaggcuaugcuacuguugcaucuaagggaauaguggcacuguuucuucccua

SEQ ID NO: 4202260 - RNA, 69 nt, Human
ugggugacauaguuacuucaggcucauaugccauuuucugggggccuuauaggagacuuugugagccca

SEQ ID NO: 4202261 - RNA, 130 nt, Human
ugggugcagcccuggguggcuggaagugggagucaggguuuucccggcagcucacagcccccaggggcagagcagggcacuggaaggcacugaucauauuucccugaugcuccccugagguuguagucaa

SEQ ID NO: 4202262 - RNA, 60 nt, Human
ugggugcaggaugagugcuggcugcugcuauugcaauguccagugcucccugcacgccca

SEQ ID NO: 4202263 - RNA, 66 nt, Human
ugggugcucugcgaccguagggagcaagucugccuuguucauuccugccucgcggcacagcaccca

SEQ ID NO: 4202264 - RNA, 97 nt, Human
ugggugcuugguucaucucugugggagucaggaaguauaaucagauucacaugggugaaagaggcugucuuuuugcuuucaagaugaacuacaccua

SEQ ID NO: 4202265 - RNA, 64 nt, Human
uggguggagagcaucccaaugauaagcauuauuuguuuggaucaaauuucaugcuguccuccca

SEQ ID NO: 4202266 - RNA, 56 nt, Human
uggguggcucuguugucaacugauauuaccauauccuuuuggcuaugagucagcua

SEQ ID NO: 4202267 - RNA, 62 nt, Human
uggguggcugcagagggcacagcauucagagucccaggagccagcuccuuuguagucggcca

SEQ ID NO: 4202268 - RNA, 89 nt, Human
ugggugggaauucuuuggcagggccagcugcagaauuagcauuaaugugauacuaaucccugggauggccccucagagcaguguaccca

SEQ ID NO: 4202269 - RNA, 59 nt, Human
ugggugggcgcucgcggggucccaucucuaaggaguaggcccagaguuaagcccaccca

SEQ ID NO: 4202270 - RNA, 77 nt, Human
ugggugggguuuguggugcaggcaguccaggugggcaucgucccagaugcucugcugguaccaguggccgucaccua

SEQ ID NO: 4202271 - RNA, 79 nt, Human
uggguuacaaugaugaauaaauggcauuaauuaaaugugcuauauaauuguucaucauuguuaauuaaaguuuuuccca

SEQ ID NO: 4202272 - RNA, 59 nt, Human
uugagggacagaggugcugucuaggaagucagauagcguuuuccaguucugucccucag

SEQ ID NO: 4202273 - RNA, 64 nt, Human
uugagggaugagugaguaaacaauauguggcaucuacauaugaugaaauauuauucacccucaa

SEQ ID NO: 4202274 - RNA, 92 nt, Human
uugagggugggguagggggaggccuuucugcaacagcagcugcucugucuuuaggcucugggcaaagaugccucaucccauccuuucagcaa

SEQ ID NO: 4202275 - RNA, 103 nt, Human
uugagguggagucucgcuguguccccgaggcuggagugcaguggcgcgaucuuggcucacugcaagcuccgccucccggguucacgccauucuccugccucag

SEQ ID NO: 4202276 - RNA, 80 nt, Human
uugagguugaacaagaccauagauaucgcagaagcaaucuuacuacagaauacuucuagauuuuuguaauuguuccccaa

SEQ ID NO: 4202277 - RNA, 76 nt, Human
uugagguuguuucaacaguagucucauuuucagauaaagaaaccgaggcuuaaagauaguaagaaaccuaccugaa

SEQ ID NO: 4202278 - RNA, 76 nt, Human
uugaguauucacuauggaguaaugaagaauucccuguaacccuuggguuguuucuaaguuacuguuauggucucaa

SEQ ID NO: 4202279 - RNA, 59 nt, Human
uugagucauuauuccaguguguugaacauuugcuauuaaaauacugggcagugacuuga

SEQ ID NO: 4202280 - RNA, 56 nt, Human
uugagucuccucagcagggcuauggccuccagauuucucugcuuuaggagagucag

SEQ ID NO: 4202281 - RNA, 76 nt, Human
uugagucuuguugcuggccccguccagaggaagcagccuuccugacucuguaccuggcauagcaaccuuagcuuaa

SEQ ID NO: 4202282 - RNA, 109 nt, Human
uugagugccaguacucugcucauaguagugggaaaugggggcggaggugggguugugcuuccacuguaaccauuaucaccauauuuuugguggagaaacugguguucag

SEQ ID NO: 4202283 - RNA, 77 nt, Human
uugaguguuuaucagacaagcccugcauggucagaaucucuucugcaugaagcugggguuuuucuaugguuauucag

SEQ ID NO: 4202284 - RNA, 71 nt, Human
uugaguucuuacaaguauuccagguccagauuccacccagauuuacugaacuagaagcuugaagagcucag

SEQ ID NO: 4202285 - RNA, 94 nt, Human
uugauagacaggugaguguucagccacuacccaccuuaacaggaucuucagggaaauuguuaggaggcuaguugagcaccaggcuguccauugg

SEQ ID NO: 4202286 - RNA, 107 nt, Human
uugauaggaaaggagugggacucugagacuuaggaugggaaaaucuggguagauucacuucagaauccugaguucucagagucuccugaaaucuuagguccuaugga

SEQ ID NO: 4202287 - RNA, 59 nt, Human
uugauauagcggccagaugugacuuugguuguuuucccuucauaugugguuguauacaa

SEQ ID NO: 4202288 - RNA, 73 nt, Human
uugaucaaucaagaauaaguuguaaagcugucugccaguauucucgguauuugcucaauuuaucuuggaucaa

SEQ ID NO: 4202289 - RNA, 76 nt, Human
uugaucagauguuugcuagaucuuuggcagguaaucauauuuguggaccacacucaucuauuagauaucuguucaa

SEQ ID NO: 4202290 - RNA, 77 nt, Human
uugaucaucugcccugcccaggccuugggcuuuaugccagcacagagcucaaaggccagguagcagcacauccucaa

SEQ ID NO: 4202291 - RNA, 64 nt, Human
uugaucauuuuagucuaauaaaaguggaguuuuauggcucauuuuaauuaggguggauaaucag

SEQ ID NO: 4202292 - RNA, 91 nt, Human
uugauccgguauuuucaguuucaaauccuggaugcacuagcagcaugaugauguguucauggaauuugcaauugagauaaugaggaaucaa

SEQ ID NO: 4202293 - RNA, 76 nt, Human
uugaucgccugguggaccagccuccccagccccucuggcagcugucugggaggccuccacuuacugaggcggacaa

SEQ ID NO: 4202294 - RNA, 62 nt, Human
uugaucggccauggaauaccuuuuucaagugcucuggaaaguuagguugcauuggucaucaa

SEQ ID NO: 4202295 - RNA, 60 nt, Human
uugaugaagggucaagaggguagcagacuuugggugcacaacacuucaauccuuuaucaa

SEQ ID NO: 4202296 - RNA, 58 nt, Human
uugaugagucugacuaguaacuuuggucaaccaaugacagguucaugacuccucucaa

SEQ ID NO: 4202297 - RNA, 69 nt, Human
uugaugauuauuuggccaagcaacuuccaaaaccuugguauuuggaauagcuugcuaauguuuucuuaa

SEQ ID NO: 4202298 - RNA, 85 nt, Human
uugaugcaaauuagauugguuuuauccuacccacacagcccuccaaaauuaggaagagggggauaagagaguauuuaugcauuaa

SEQ ID NO: 4202299 - RNA, 104 nt, Human
uugaugcacuacuauguuuuauuuuauucaacaaugaaagcuaaggaaucuguaugguuaaacuuucagcuuugguuguuaugaaacucuggauuugcuuucag

SEQ ID NO: 4202300 - RNA, 63 nt, Human
uugaugcuaaauucauuauugauuuaucauucuucauggauaccauaaugagauuggccucag

SEQ ID NO: 4202301 - RNA, 130 nt, Human
uugauggaauaugugcugagaaauguauagugaauuuuuccucugauaccugcuacaaagcauaagauccccugaaggacuuuauugcauuuuaucaccaaaaaagcacauuagcacucuaucccauuga

SEQ ID NO: 4202302 - RNA, 71 nt, Human
uugauggcacauuucaguaaguguuaauuuggauuucuuuagaauucacuuuauauggaaaaggucaucaa

SEQ ID NO: 4202303 - RNA, 57 nt, Human
uugauguagaaccaagaucuuuuauuugauuaaggaucuucuuggggucuacaucaa

SEQ ID NO: 4202304 - RNA, 88 nt, Human
uugaugugugacuucagaauagagacuacucagagauauguaaucuuauuagugucugucugaguuuuuucacugucauaacguacaa

SEQ ID NO: 4202305 - RNA, 70 nt, Human
uugauguugagugggaagggggacuuucuguuuggauccaaucccagaauacccaucccuucaacuccaa

SEQ ID NO: 4202306 - RNA, 76 nt, Human
uugauguuucagaggaggaaggcaguuaggggaauauuuuccucccuaacauuuuaucccugcugaaauaagucaa

SEQ ID NO: 4202307 - RNA, 56 nt, Human
uugauuacuuaaaccuucuguugagcuuuuagacagauggucuuuugaguaaugaa

SEQ ID NO: 4202308 - RNA, 74 nt, Human
uugauuauagaaucuuggcuuugaugggacaacuugggaagggguccaaggaagugaagguuacucuagauugg

SEQ ID NO: 4202309 - RNA, 57 nt, Human
uugauucauuuauugagugccuauuuuuucagaugcugggcauucaguagugaacaa

SEQ ID NO: 4202310 - RNA, 75 nt, Human
uugauugacuguagaggccuggauugaggaggccugugcuucugggccccuggcuaggcuuccacaguugcucaa

SEQ ID NO: 4202311 - RNA, 65 nt, Human
uugauuuauugcacuauugauuuucuagacuuaagcaagugauggagaaagugucaaugauucag

SEQ ID NO: 4202312 - RNA, 63 nt, Human
uugcaaaacagguagugggcuagaucuggcuugcaggccacaguuugccaacaccuacugcaa

SEQ ID NO: 4202313 - RNA, 81 nt, Human
uugcaaaggcuuccugggcccugcuuaagcaaugucugagauuucagaauguguugugggagccucagggaggcugggcaa

SEQ ID NO: 4202314 - RNA, 129 nt, Human
uugcaacaggauuagauagcaacaugucucuccauaaauguuuuguggguugaguuucuuuaaggagaacuuaggaaaauaaggcaugauggagagggugcaauugaugaggucugauacauaaagcaa

SEQ ID NO: 4202315 - RNA, 57 nt, Human
uugcaagaaugccuaaggaugccuauugguuguggggcaaaucacagguaauugcaa

SEQ ID NO: 4202316 - RNA, 74 nt, Human
uugcaauuacagaugaucucacagcagaaaauaacugcguaauuguuuucuguguagagaucacagaauuguag

SEQ ID NO: 4202317 - RNA, 66 nt, Human
uugcacaauguaggauauguacuugugugagauuucucuacauacuuuagcacugcauuguugcag

SEQ ID NO: 4202318 - RNA, 87 nt, Human
uugcacaauuccaggaggcagcauucgcauagacagccuaccugugaucagccugggaugugacuguugcccccaugaguuaugcaa

SEQ ID NO: 4202319 - RNA, 87 nt, Human
uuccacauuaguucauucagacuuucagauaaucaagaugguuuuuuuaacucaucuucagagaguuggaaagaauuaauaauagaa

SEQ ID NO: 4202320 - RNA, 60 nt, Human
uuccagagaggcucauguucccucggguacuggaacaaaaugaaagcuuuucaaguggaa

SEQ ID NO: 4202321 - RNA, 80 nt, Human
uuccagauggaaaagccuguggauaaaccaagaagcccccuuuaggacccuuuucaacuacagguuaauuuucaguggaa

SEQ ID NO: 4202322 - RNA, 63 nt, Human
uuccagauuugaaguaaguaaugaguauuugaagaaaaugcucauucauuuucagguagugaa

SEQ ID NO: 4202323 - RNA, 77 nt, Human
uuccagcaagugcccacugaggcccaguccugcaagcacguaccacgugagcagcucugugucucuggaaccuggaa

SEQ ID NO: 4202324 - RNA, 69 nt, Human
uuccagcagagggcccuggcugcggucuucccacugcuuugacaguacccaguuagagcccuuuaggaa

SEQ ID NO: 4202325 - RNA, 59 nt, Human
uuccagcaggguacuuguaauucccagcuucaugggagucaagaugcaucugugaggaa

SEQ ID NO: 4202326 - RNA, 87 nt, Human
uuccagccguggcagcuacagguggcaagacuguggggaaaugauuuuauuugucuugccauuuaguuucucaucugcaaaauggaa

SEQ ID NO: 4202327 - RNA, 86 nt, Human
uuccagcgaguucuaucaggaaaauuagccugacauuuagcagucuuuagcaagagucaaaauuuaccagaaugaaccguaaggag

SEQ ID NO: 4202328 - RNA, 57 nt, Human
uuccaggagacccagaauguugcuguggucuaccaggcagaguagggacuuguggaa

SEQ ID NO: 4202329 - RNA, 57 nt, Human
uuccaggcuucucuggggcgucaucugcacucgcgcugccucccuggagccugcgaa

SEQ ID NO: 4202330 - RNA, 71 nt, Human
uuccagguccuacuggcccauagugucaggacccuggcuguuugggcugugggcucucaugggaccuggag

SEQ ID NO: 4202331 - RNA, 124 nt, Human
uuccaguaugucacuaugguagaaaaagagauggguaaaauucuagcaucugaaaggaaauaaucuuugccaggcuugcaugaauuugauccuagcuuaucuuacauauuguacagacugugag

SEQ ID NO: 4202332 - RNA, 59 nt, Human
uuccaguccagggcuguuuccacgacgcacagucuguggucuuagcguuugguuuggaa

SEQ ID NO: 4202333 - RNA, 65 nt, Human
uuccagucuggcucagcacaaaggggcugaugaucacuucuggugucaaggccaggcaucuggaa

SEQ ID NO: 4202334 - RNA, 55 nt, Human
uuccagugaugggcaauuugguguuuuuuuaagaccauuuaucccauuaauggaa

SEQ ID NO: 4202335 - RNA, 58 nt, Human
uuccagugcuuuuuuaccuuccaacccugaacauguugagagaaagagaagccuggag

SEQ ID NO: 4202336 - RNA, 58 nt, Human
uuccagugggcugggaguaagggacagauuguggacccugacgaaaggcgugcuggag

SEQ ID NO: 4202337 - RNA, 75 nt, Human
uuccaguuuaagcaaguugacauagcauaauccaguacauaugacuaugcaaggguuuaguuguuuaacuuggga

SEQ ID NO: 4202338 - RNA, 94 nt, Human
uuccauaagagcuauuucauaacagcuuccuuuuacucccauaaagucacccagugacuaaagguuaguucuuagaagugcacuucacauggaa

SEQ ID NO: 4202339 - RNA, 57 nt, Human
uuccauauucccaauuuugccaccugaucacuuugagguaaaauguggagcuuggaa

SEQ ID NO: 4202340 - RNA, 71 nt, Human
uuccaucgugaaggucucaguccccuacagacuaauggugaguggauguaacaugggaccugcgaaaggaa

SEQ ID NO: 4202341 - RNA, 129 nt, Human
uuccaugaauuuccuuagcccuugauccuaaacuauugagaaagcuuacauauccaaaaugagucuaacuuuucuaagcaauggucuugggagauguacauauuucacuagggcuuccuggagcuggaa

SEQ ID NO: 4202342 - RNA, 71 nt, Human
uuccaugcagggacuagagaacaggaagagcaacaguaguccucuuguucuacccuauccacuacauggga

SEQ ID NO: 4202343 - RNA, 103 nt, Human
uuccaugcuucacuggcucaagaacaguuugccaaauugguggacuacuuugccaauccuugcuagcuuuuuuagagaucagaaaaugaaaacccugcuggaa

SEQ ID NO: 4202344 - RNA, 76 nt, Human
uuccaugucaucuucaguuuucagugagccaucauuccaaccugcuggcaaacacccaggaauggaggacauggag

SEQ ID NO: 4202345 - RNA, 55 nt, Human
uuccauguguacauauguguuuauauguuugcauguguguaugugcacaugcgaa

SEQ ID NO: 4202346 - RNA, 70 nt, Human
uugccucucaggaggugauucauauuucaauauauuccagcugaaaaaggaucagauuuugagcaggugg

SEQ ID NO: 4202347 - RNA, 56 nt, Human
uugccugaggcuuuguaauauccucacuguaguagaguuguugaaacuucagguaa

SEQ ID NO: 4202348 - RNA, 83 nt, Human
uugccuggcucucugagauauugagucuucaaccuuuagcugccugugagugacugcucaaaugucauggggagccucugcaa

SEQ ID NO: 4202349 - RNA, 101 nt, Human
uugccugugagcagagagguucugacuugugcauugcuguuagauauggagaggaacaagcacagccacugagugagaaccccacaaaugcugauagacaa

SEQ ID NO: 4202350 - RNA, 80 nt, Human
uugccuucagggagcuugugugcaggugcacgguuugauuccuaaucauaaauaguugugccugaaugcagugaaggcag

SEQ ID NO: 4202351 - RNA, 92 nt, Human
uugccuucauuauuccuggggaugaaauagaauuaauuuaggccauggaaucuucgacugccuguucuuucacccaggaguuguggggggag

SEQ ID NO: 4202352 - RNA, 69 nt, Human
uugccuuguggccuucuguuccugagccucuucugugugugcagggaggcagcagguuguccaggguga

SEQ ID NO: 4202353 - RNA, 59 nt, Human
uugcgcauguacccauacaucugcaacauaccccagcacauauaugugcacaugugcag

SEQ ID NO: 4202354 - RNA, 86 nt, Human
uugcgguccaugggagugacugguuguauauggaauguuccugcaaguaugggacaagcaguaaaggccacagucucaggauccaa

SEQ ID NO: 4202355 - RNA, 55 nt, Human
uugcuaaaaauggaauuauaggugucuuuagggauaaauauauaauuuuuggcag

SEQ ID NO: 4202356 - RNA, 66 nt, Human
uugcuaagagcuucaugccaggagguuuaagaccuaugucuuaugacucagcgugagcaagagcag

SEQ ID NO: 4202357 - RNA, 76 nt, Human
uugcuaauuagaggggucuuguggccuagaacagcuucuuagucuuggcuuuaggccaaagccuaacuagauguaa

SEQ ID NO: 4202358 - RNA, 74 nt, Human
uugcuacagaaaccugauguauagauucuagaugugcaaacauaaagaauguauaucaagggagaaugugacaa

SEQ ID NO: 4202359 - RNA, 68 nt, Human
uugcuaguaguguguaggagaaccaguggugcacaccuucugggcaguuuuacaucauugcauaguag

SEQ ID NO: 4202360 - RNA, 57 nt, Human
uugcuagucucuguuucaggauaggguauuaacuaucugggcagcagcagcuaguag

SEQ ID NO: 4202361 - RNA, 57 nt, Human
uugcuagugggaacugaguauugcuugguagauaaguaaucucaguauccuaugcaa

SEQ ID NO: 4202362 - RNA, 111 nt, Human
uugcuauuuaauuuagacauucugucuguggagcuucugauguguauuccuuaucuaacauauacauuacuugauaagacaggcucuaugauuaucuaaauugaaaagcaa

SEQ ID NO: 4202363 - RNA, 114 nt, Human
uugcuauuugcauagucauuucauuggauaguuuaugaaaaauggaagggaaaguauuuucuuacagugccauuuuucacaagacucacuuccugaugagaacaugagaagcag

SEQ ID NO: 4202364 - RNA, 76 nt, Human
uugcucacacacucuuccuggcaccuagcacaauucuuggcacagaguaggugcucgggaaguguuuguugaguga

SEQ ID NO: 4202365 - RNA, 61 nt, Human
uugcucaccaacucugaaaauccagauauagcaguagaugcuaggaaggaguuaggagcaa

SEQ ID NO: 4202366 - RNA, 129 nt, Human
uugcucaccuuucaugaagggcugauagucaaacuuggguauggcugugccaguuguuuauggccaguggucuccugguuagucaguaccugagugugaucaguuguuacauguuuuguauaugagugg

SEQ ID NO: 4202367 - RNA, 60 nt, Human
uugcucaugugugauuacaguuuuugguguucacagaggaugaaagucauuuaugggcag

SEQ ID NO: 4202368 - RNA, 129 nt, Human
uugcuccauggccccccucgcccccacccacccccaaucccagcccagaacgguggcagucauucugcccagcaguggggcgcugggaguugguggcuggguggggcgacgagguggcgucugcugcag

SEQ ID NO: 4202369 - RNA, 57 nt, Human
uugcucccagcugcccugcaugguuuaauagacaacuauguaaaagacagggaguag

SEQ ID NO: 4202370 - RNA, 65 nt, Human
uugcucuagggcucagcucuagcuccugaugaaaaccagaucugggagcuuggagccuuugguga

SEQ ID NO: 4202371 - RNA, 68 nt, Human
uugcucugacuggagugcagugguguggucauagcuuacugcaaccuuuaacuccuaggcucaagcaa

SEQ ID NO: 4202372 - RNA, 76 nt, Human
uugcucuguugccuaggcuggaguguaguggugugaucucggcucacugcaaccucugccucccggguucaagcga

SEQ ID NO: 4202373 - RNA, 73 nt, Human
uugcucuuacucaaauagcugccccuaguggacugaagaguuauuacuggagugaguuuggaucaaagagcaa

SEQ ID NO: 4202374 - RNA, 79 nt, Human
uugcugaacagugguucaugucacggauuucuucugcugauaauuauuuaguaccgucgauaggacauaguggaaguaa

SEQ ID NO: 4202375 - RNA, 69 nt, Human
uugcugaggcugggcuugccuucuugguuacgaggccaugacgggcagucgcucagcccuccuuaggaa

SEQ ID NO: 4202376 - RNA, 62 nt, Human
uugcugagucucuagguaugaugagcacaguaauuugaaacuguaaccugagauuaaggcaa

SEQ ID NO: 4202377 - RNA, 79 nt, Human
uugcugauuuuauauggcauacuguggaauugggacuuuauccuaagaacuauggggagccauuuaaaggauuaagcaa

SEQ ID NO: 4202378 - RNA, 101 nt, Human
uugaggcaggagaaucgcuugaacacgggaggcggagguugcagugaguccagauggcaccacuacacuccagccuggcgauaagugagacucugucucaa

SEQ ID NO: 4202379 - RNA, 93 nt, Human
uugaggcauaauugauauagaaaaauugcacguguuuaugcuuuuugaugagcuugaacauaugcauguuuguuuuguuuuauuuuguuuuaa

SEQ ID NO: 4202380 - RNA, 78 nt, Human
uugaggcccacaguggauugggugaugcccacccccauuggggagggcaaauccacuuuacucaguuuacugauucaa

SEQ ID NO: 4202381 - RNA, 59 nt, Human
uugaggcucugugaugugccaggcacuguucuaagugcuggagacauagcaggcagcaa

SEQ ID NO: 4202382 - RNA, 103 nt, Human
uugagggggagucucgcucuguugcccaggcuggagugcaguggcaggaucucgguucacugcaagcuccaccucccggguucacgccauucuccugccucag

SEQ ID NO: 4202383 - RNA, 67 nt, Human
uugaggguuacuccugacuguguuaacuagaaucucuaguuugucacaugcaggcaguggccuucaa

SEQ ID NO: 4202384 - RNA, 56 nt, Human
uugagguaaagcuacuaguuaguuuugaagguaauggagcuaggcaagugccucag

SEQ ID NO: 4202385 - RNA, 76 nt, Human
uugagguaauaaacagccauuccuguuggauaaccccagagagugagacuuggcugcauaucccuaccugccucaa

SEQ ID NO: 4202386 - RNA, 130 nt, Human
uugagguagagucuugcucuugucgcucaggcaggagugcaguggcgcaaucucagcucaccacaaccucugccuccuggguucaagccacugcacuccagccuggcgacagagcaagacucccucucaa

SEQ ID NO: 4202387 - RNA, 103 nt, Human
uugagguaggguuuugcucuguugcccaggcuggaguacaguggugugaucacaacucacugcggccucaaccucccaggcucaagcgauccucccaccucag

SEQ ID NO: 4202388 - RNA, 77 nt, Human
uugaggucagcaaagaguguuaaaaaucccaugauaugaaauuuucauuuaaugcacggauguagccucugacccag

SEQ ID NO: 4202389 - RNA, 56 nt, Human
uugaggucucuacagaagagugauagauaucuauucucuguugaaugagauaucaa

SEQ ID NO: 4202390 - RNA, 57 nt, Human
uugaggucuugaguacuggggaacauucauauagaggugagcaguuuuaaggcccaa

SEQ ID NO: 4202391 - RNA, 103 nt, Human
uugagguggagucucgcucuguugcccaggcuggagugcaguggugcaaucucggcucacugcaaugucuaccuccuggguucaagcgauucuccugucucag

SEQ ID NO: 4202392 - RNA, 87 nt, Human
uugagguuuauaaagacaggucuacuggcaagcaguggauaguuuguucauguagcuuuguggaccugaguacacuuguaucuucaa

SEQ ID NO: 4202393 - RNA, 68 nt, Human
uugaguaaagggccagauaguaaacacuuuagguguugaaggauauguggucuuuccuaacugcucag

SEQ ID NO: 4202394 - RNA, 83 nt, Human
uugaguagcuuggucuguagaugagucuuaagaauuugauuccauaugugaauucugaaauuucuguagaucuuguuacuugg

SEQ ID NO: 4202395 - RNA, 109 nt, Human
uugagucagggagccuggaccugugacuuggugaggccccagggauuaggccaaccacaggucugggguaccuggcccuggggcugcugccuagucauuucugacucaa

SEQ ID NO: 4202396 - RNA, 73 nt, Human
uugagucaguuuucuccagggggcuaaauuacuuuuuggaaguaaacucagagcaauggaagaauugauuuaa

SEQ ID NO: 4202397 - RNA, 55 nt, Human
uugagugacugagagcagugcuuuucaaacgguaauguucaaacagaucacuuag

SEQ ID NO: 4202398 - RNA, 58 nt, Human
uugagugacuucaaaauucaguuagacaaaacagacagcugaguucugugguucucaa

SEQ ID NO: 4202399 - RNA, 99 nt, Human
uugagugucuacugugccaguuagugugauggagguacgaugguaagcaugcagaaucauuccucgcccucacagugcacuaaucaagugaucauuuaa

SEQ ID NO: 4202400 - RNA, 63 nt, Human
uugagugugguaugcucugaggcugaaucacauaggaugcagcuuucacaggauuacacuuaa

SEQ ID NO: 4202401 - RNA, 65 nt, Human
uugaguucuggugguuuggagaucuuuguuccccagaacaaaggaaugcuuucaccaggacacaa

SEQ ID NO: 4202402 - RNA, 71 nt, Human
uugaguugacaucuugguugcaauuaguuacaaaagugguuccaauauuauuucaacaggugucaacuugg

SEQ ID NO: 4202403 - RNA, 67 nt, Human
uugaguugcaugcuagaauucccauuuugggcauuggcucagacuggggagagucaugccagcacaa

SEQ ID NO: 4202404 - RNA, 60 nt, Human
uugaguugggugucuaucaccuacaaacuaaaugucagugcacagucaagcccagcuuag

SEQ ID NO: 4202405 - RNA, 85 nt, Human
uugaguuucuaauuaauuucuggagggagaaagaguagaacaaaguauucccuugacuucuucuagaaauaagcaagagaaccaa

SEQ ID NO: 4202406 - RNA, 56 nt, Human
uugauaaacuuguggaguuuuggucuccuaguaggcacucuauaaauguuuguuga

SEQ ID NO: 4202407 - RNA, 124 nt, Human
uugauauauacugauccauuuuuuuaggggcuaugcagauucaaaugaaaugcaacacaaugaaaauauguaguucauugucaaugaaugcaugguauuugcauguggguuuguauauuguuaa

SEQ ID NO: 4202408 - RNA, 81 nt, Human
uugauauucaugagcaucucuauagugacugugccuggcagguauagcaugugugguggugaaauggggcugacaugucaa

SEQ ID NO: 4202409 - RNA, 83 nt, Human
uugaucaggcuucauuguggcaucaggacccuugagaaucuauuuuucuuugcucaaauucuaugcucaauggagccuuuuaa

SEQ ID NO: 4202410 - RNA, 82 nt, Human
uugaugaaacaugggcaguuugggaaaauggucugaaccuccaaguaucaguguuccuugagacugccaauugauacauuaa

SEQ ID NO: 4202411 - RNA, 56 nt, Human
uugaugaggcaugggaucaaaaugauauuagucauuugauugagugccuuaugcag

SEQ ID NO: 4202412 - RNA, 79 nt, Human
uugaugauauucagacugcuuagcucccaguaguccucagaaguuaccuuggaggccaagcaguuuagggaaugaucag

SEQ ID NO: 4202413 - RNA, 60 nt, Human
uugaugcugacugaccaaaaggauagauucugcuggcuauuuacugucucucagcuucaa

SEQ ID NO: 4202414 - RNA, 121 nt, Human
uugaugcuguauuuuuccauauaaauuguuaaauuggcuuugugguuucugcaucaaucuauuguugcacugaucagggagccuaauuuacucuggauacacugacaaaaacaaauuucaa

SEQ ID NO: 4202415 - RNA, 61 nt, Human
uugauggcaaggguuuacauucggauaaaaccauuucacccaugcaagcccucuccauuaa

SEQ ID NO: 4202416 - RNA, 79 nt, Human
uugauggcaauauuguauaauagugggcuacugagcaacuauuuccagcuucguggucagugguacaguuugaaaucaa

SEQ ID NO: 4202417 - RNA, 73 nt, Human
uugaugggaaguucugaccauauggccaagguaaaggaauccuaggaguuugaagucagacuucauuaaucaa

SEQ ID NO: 4202418 - RNA, 81 nt, Human
uguguuucuugcacuccccggacuguggcgaaauggcgugcuuugugugucugugguuggggggaagugggggaaaugaca

SEQ ID NO: 4202419 - RNA, 76 nt, Human
uguguuuguccugaugugaacauuuuuggucauuauuuaccauaaugauuacugaucgcauaggaaggaagacaca

SEQ ID NO: 4202420 - RNA, 60 nt, Human
uguguuuguguuucagacgaaucaaaguaaaaaugcuuuaagugaugaaaugcagauaca

SEQ ID NO: 4202421 - RNA, 62 nt, Human
uguguuuugugucacauuacacugauuguggaucaguuaguguccuuaugucacaagcaaca

SEQ ID NO: 4202422 - RNA, 68 nt, Human
uguguuuuuaguuuaaguuuuugcagugccuuaguugcauaagugcaagagcccaaacuauauacaca

SEQ ID NO: 4202423 - RNA, 63 nt, Human
uguguuuuucauuuguuucaguugcauaaguagguguccuauuuugcaauaaaugaaagacca

SEQ ID NO: 4202424 - RNA, 85 nt, Human
uguuaaacaugcagacuccugggucccaucccagagugacugagucagaauccagcguggggcccagaaaaguaacaguuuaaca

SEQ ID NO: 4202425 - RNA, 73 nt, Human
uguuaaaguuuggcagacaauaacacaaaaaaagcaauuuuaccugcuacagugucugucugcuuacuugaua

SEQ ID NO: 4202426 - RNA, 68 nt, Human
uguuaacauauggagaugauaccacauuugccuguuuggguacuagugucauuccuucaauguagaua

SEQ ID NO: 4202427 - RNA, 81 nt, Human
uguuaacaucccagguuuuguguagaauagcuuaucugguucaucaggugagugugacugcaagagaugggacaaaugaca

SEQ ID NO: 4202428 - RNA, 70 nt, Human
uguuaagacuguacauuuuccagucuuuggaaacagccuuauuuugaaaacugggcauguacacuucuca

SEQ ID NO: 4202429 - RNA, 73 nt, Human
uguuaagagucuuauaguguaauuaaggggccccucaguauuucuugaaguauauuuuauagggcucugaaua

SEQ ID NO: 4202430 - RNA, 75 nt, Human
uguuaagguguaaguauaaaaugcuaagcuuuuaucccuagaaauucagcaaaaagauacaggacaccuuuggca

SEQ ID NO: 4202431 - RNA, 68 nt, Human
uguuaaguaauggccaagcuuacucuguuguguauuaaggacaagauagauuauuuuggcacuuguca

SEQ ID NO: 4202432 - RNA, 74 nt, Human
uguuaauaggaaucagaauuaggauuugaagccaggaccgccugauuuuuuucaaaauucuguuuccuacaaca

SEQ ID NO: 4202433 - RNA, 72 nt, Human
uguuaauuaacaaauauuucccaugcccagcacguuuggauguuuggagggcuggauguuugaugacgaaua

SEQ ID NO: 4202434 - RNA, 69 nt, Human
uguuacccagucuggagugcagugacaccaucucggcucacuguaaccuccgccuuauggguucaaaca

SEQ ID NO: 4202435 - RNA, 74 nt, Human
uguuacgguaacuucucugcuaucauaggauaagugaggcauaugaucuuuugaaaagcagauguuaaguggca

SEQ ID NO: 4202436 - RNA, 65 nt, Human
uguuacugcaaaaaguuugcaauggccagcucgugaguuccauuuggcaaacauuuuacagagca

SEQ ID NO: 4202437 - RNA, 129 nt, Human
uguuacugcuuccuguucugagacuccccuucuggcaaccuuuuccucucacuccucacuguuucuucgggguagaaaauuaggaugaggcuuguuaacaugggugguucaagucugggaagcuuaaug

SEQ ID NO: 4202438 - RNA, 58 nt, Human
uguuagaagacucuuuuaccuauaauuuuguguucagugauguugggggucuucugca

SEQ ID NO: 4202439 - RNA, 85 nt, Human
uguuagaaugcauguugcuuggcccacuccagagaauccgauucaguaggucuggggugggccccagguaucuguauuuuuaaca

SEQ ID NO: 4202440 - RNA, 88 nt, Human
uguuagauucaaauguauggcaguuucacucugggauuccaccaaaaggaaucuguagggaacaacuguacagaacacagaacugaca

SEQ ID NO: 4202441 - RNA, 64 nt, Human
uguuaggaaggaagcucgauauuuccuuuuaagaaaggaaguuauaaacuuuuccucccagaca

SEQ ID NO: 4202442 - RNA, 83 nt, Human
uguuaggcugaaacauaugaagaugucuuuuuguaggucaaaaucugucaaauauugacagcuuuauuacauucaaucugaua

SEQ ID NO: 4202443 - RNA, 96 nt, Human
uguuagguagaauucagaauauuuguuuuacauggcaacaauuaaacuauauauugcuaucuauuuaaaaucguguucugcccauucucucuaaca

SEQ ID NO: 4202444 - RNA, 84 nt, Human
uguuagguuggugcaaaaguaauggcgguuuuuaccauucaaaguaauggcaaaaaacgccauuacuuuuguaccaaacuaaua

SEQ ID NO: 4202445 - RNA, 83 nt, Human
uguuagguugugcaaaagugauugcugguuuugccauuaauuuuaauggcaaaaacugcaguuaccuuuguacaaaccuaaua

SEQ ID NO: 4202446 - RNA, 69 nt, Human
uguuauagauaaaaaggcugagucaccagcagcagcagagacuuagcagguacuuucauauuuuuaaca

SEQ ID NO: 4202447 - RNA, 80 nt, Human
uguuauagcagcacaaaguggaccaagugccuuuucauguacuauguccuuaaccacuuguguuuauuccugcuguagca

SEQ ID NO: 4202448 - RNA, 76 nt, Human
uguuauaguggcguuguccaaacuugaguggagcaauugacaguuccacaucuagguuugucaacaacaaauaaca

SEQ ID NO: 4202449 - RNA, 78 nt, Human
uguuaucccaguugcucagucaguuuuugugagagauucagggaucuuaauaaaacugugcugcuacugcuacuaaca

SEQ ID NO: 4202450 - RNA, 82 nt, Human
uguuauguacagguuagcaaaaauaucucauauuacuguguaguuacuuaaaaauuuuugcuuuagggcuguguacauaaua

SEQ ID NO: 4202451 - RNA, 130 nt, Human
uguuauguguauuuacuacaauuuuuuaaaaaucguauauguaguuuaacagguguggucaauaucaaaacuuagguauuuaaucuuguuaaauuauauaagcagaaaaugcuggaaaaaguaccuguca

SEQ ID NO: 4202452 - RNA, 59 nt, Human
uguuauugagguuacuuauaaggugugauagaaacaccaaggaagaacacucaauagca

SEQ ID NO: 4202453 - RNA, 64 nt, Human
uguuauugggcuuuaauuccagagaggaaaccaaugccccucuauucugagaagcccaauaaua

SEQ ID NO: 4202454 - RNA, 130 nt, Human
uguuauuguucuauuuauuuuuucuguguuuaccucaaguuggcaugaacaaauuaguaaaauagcuugcaaauuugugcaucuguuaauuaugucuaaggcccaguacuagaauauaugaauuuaaaca

SEQ ID NO: 4202455 - RNA, 117 nt, Human
uguuauuuaaaccuauuuuauuaucucaugcugacuuuuaccuguagcuuguagguaagcaauuuagaaucugacagucacaguggaggauuaauaugggaaugauagguuauaaca

SEQ ID NO: 4202456 - RNA, 82 nt, Human
uguuauuuucauaaaaagcaaggggcuuagacagugacuaucauaacugaauggaaucaucccugcuuuaagaaagguaaca

SEQ ID NO: 4202457 - RNA, 67 nt, Human
uguucagauuucaugaguaauugccauguaaaagguaacuuggcggugggcucagugaagcugaaca

SEQ ID NO: 4202458 - RNA, 79 nt, Human
uguucagcaucuggugagggccuaguuucugguucuuaguggcaccuucuggcuauauccucacaagauggaaugagca

SEQ ID NO: 4202459 - RNA, 62 nt, Human
uguucaguugaccguggcucugggguauugguuggaaccagaggagcuguguuagcuggucg

SEQ ID NO: 4202460 - RNA, 72 nt, Human
uguucauguuucauuuguuacuauaauuauauaauuuaauucaguguuaagugaaaugaugaaaugugaaua

SEQ ID NO: 4202461 - RNA, 63 nt, Human
uguucauuaguggaaguaaguugugggcuaaggccugcacuaaugcugcacugaugcugagca

SEQ ID NO: 4202462 - RNA, 58 nt, Human
uguuccagugcagagggcucuuuaugaaacaugcuacaguguccuuuuacugugaaua

SEQ ID NO: 4202463 - RNA, 73 nt, Human
uguucccaaucgaugugacaguauguuucaaugaacagaucagauugaauucauuucucauugagugagaaua

SEQ ID NO: 4202464 - RNA, 61 nt, Human
uguuccccucaaauauuuguuggagauuauucugcuagggaagaacgagggaauuagaaca

SEQ ID NO: 4202465 - RNA, 82 nt, Human
uguuccuccaggagguagugcuuaauuucccccaccuuaaguguggauugaacugagugacuuccuucuaaagaagagaaua

SEQ ID NO: 4202466 - RNA, 80 nt, Human
uugguuagguaguggaaccuucuaaaugacgcacuaugugauuccugugucauauagaauguucuaugauucuuagccag

SEQ ID NO: 4202467 - RNA, 75 nt, Human
uugguuagguuagaccuauuuucucagaauauaccgcucuguaggauucugaguuagagucagccagaagaccaa

SEQ ID NO: 4202468 - RNA, 70 nt, Human
uugguucaguuuacauuaaaaucugugcuuauaaguaaaacacagcagauuuauugcaggcugaugcugg

SEQ ID NO: 4202469 - RNA, 103 nt, Human
uugguuguugauugaaagacauaaaauggaauucuguugcuguaagaaacacauggcauuucaguguuauucuaauuuuaugaguuucuauuauacauacuaa

SEQ ID NO: 4202470 - RNA, 77 nt, Human
uugguuuggagaagcuguagguggacucauuagacauggaacauuuuaugugagugcuuaaggauuucucuagcuga

SEQ ID NO: 4202471 - RNA, 93 nt, Human
uuguaaaaaucuuuguauaaaagguuuauuguagguguaaauuuuaugcauuagauugcacuuuauagaaacuuuugaaaaauauuuuggcaa

SEQ ID NO: 4202472 - RNA, 89 nt, Human
uuguaaaaugacaggguaggauuauggugaugucuuaggggcugucuuccagcucuaucauucugugauucuaaaucccuuuauaacaa

SEQ ID NO: 4202473 - RNA, 58 nt, Human
uuguaaacuucuuuugguuuuauggccauagugcgcuuuagacauaaagaguuugcaa

SEQ ID NO: 4202474 - RNA, 61 nt, Human
uuguaacuuugcauacuccuguucccccauccccagugagucugugcugaagaaguuacaa

SEQ ID NO: 4202475 - RNA, 69 nt, Human
uuguaagcccugcagucucugccacagcuauucaacucggcuauuguggugagaaaguaguguggacaa

SEQ ID NO: 4202476 - RNA, 77 nt, Human
uuguaaggguuacaagaaaacaucucuuccuagaucaagaucaacccuagugagaaguguauuacuuggucuuacaa

SEQ ID NO: 4202477 - RNA, 58 nt, Human
uuguaauugucauagcuuagguuuuauacauauuguguuguaagcaaugacauugcaa

SEQ ID NO: 4202478 - RNA, 130 nt, Human
uuguacaauuugcauuuauaaaaccgugauuauaacuugguaugcuaugagauacagagauuuauuguuuuaauaagauuucagguaagaaaacuaagaacuauaaauugguaauaauguagaaaagcaa

SEQ ID NO: 4202479 - RNA, 82 nt, Human
uuguacagcuagaagcagcuugguuuuaggcauggaaugaaccucucugcucaugcuuaugaagcuguuacuuggucaacaa

SEQ ID NO: 4202480 - RNA, 70 nt, Human
uuguacugcccuccuccugagcccauguuagacaggucuuauagucaaggcaggguaggaggguggacag

SEQ ID NO: 4202481 - RNA, 82 nt, Human
uuguacuuccgugccugaagaaaacuugcagcacugguauacugccuguaugucgggguuucuucuggcaggaaggauacag

SEQ ID NO: 4202482 - RNA, 76 nt, Human
uuguacuugucauggcuguuuagcuucucugcuucacuagaauauacagggagaaacagcuuaggaugugauacaa

SEQ ID NO: 4202483 - RNA, 85 nt, Human
uuguagaagggauuugagauuuuugccuauuuuacgugcucaaaggugggaaauauucuaaaagucuugugaauuuuguuuacag

SEQ ID NO: 4202484 - RNA, 130 nt, Human
uuguagcaaguguugaucucugugguguaaauauucccaucauguguaauuucaagcuacaaugcaaaguugggaagagauuuccacaucauuagauaguauucccaucauauagaugauauagaugcaa

SEQ ID NO: 4202485 - RNA, 70 nt, Human
uuguagcagaugggagauggagcugccuagauggggugauuucagggauagcgcacucauaucugcucaa

SEQ ID NO: 4202486 - RNA, 80 nt, Human
uuguaggaugcaagucgggaggaaaggcucuaaagagaagcaaacuucucuguggccuccuuccacuuacagcucuggga

SEQ ID NO: 4202487 - RNA, 68 nt, Human
uuguaggccacagagaggagauuucgaucuucauuggagagagguucauucagcucugucaccugcaa

SEQ ID NO: 4202488 - RNA, 70 nt, Human
uuguagggaaugauacauaaaccaucauuuuguguaauucucacaauggcuuuauguaucaucuccacag

SEQ ID NO: 4202489 - RNA, 60 nt, Human
uuguauagacuagcuuucacgauguuagggaauuauuauugugugauaauggucuugcag

SEQ ID NO: 4202490 - RNA, 58 nt, Human
uuguauauaaagcccccacuguuugucaagaaagugauguuagggguauuauuuauaa

SEQ ID NO: 4202491 - RNA, 68 nt, Human
uuguauauugcaaucccuagugaccuugcaggaccacuagagcaaagucauggggaugcaggucauaa

SEQ ID NO: 4202492 - RNA, 90 nt, Human
uuguaucauguuugcuauuguucuaguggcugaagcaaaccacauagucaaaccuagaaggagagcaacaauccaagggcauggcuacag

SEQ ID NO: 4202493 - RNA, 84 nt, Human
uuguaugacagauaagaggcauuuggcugucauuuguaguuuuugauuacuaguaaggucaaaaugcuuuuguauguuaaauag

SEQ ID NO: 4202494 - RNA, 65 nt, Human
uuguaugagcuccaggaacucaagccucaauuucuguaucugugcauuuguucccagcucugcaa

SEQ ID NO: 4202495 - RNA, 57 nt, Human
uuguaugcuguaggcaugcauuuuuuuaaguaaaugaguaagccccauagcaagcaa

SEQ ID NO: 4202496 - RNA, 84 nt, Human
uuguauuccugcuuuaccaaacucuuggauucauguaucuuuuguuccacucauucauccugacuaugggaaguaggaagccaa

SEQ ID NO: 4202497 - RNA, 110 nt, Human
uuguauucguagagucaguccuggaauugaggagaccagcguguccuuugaacgugcuagaaaauaugacugugcuccuuaaaggauaaaauacgacucugcgccuccaa

SEQ ID NO: 4202498 - RNA, 56 nt, Human
uuguauuucuuccggucucauuugugaugagagucauaagauuuugagaaauacaa

SEQ ID NO: 4202499 - RNA, 126 nt, Human
uuguauuuuaauuccuuggccuuacucuuucaggaaaguugagcagguaaaagaauucauuuauacaguuaaauaagaacuccauuuacucgugcucuccucggcugauuuuaaaggcagauauaa

SEQ ID NO: 4202500 - RNA, 67 nt, Human
uugucaaccauccaacagauauuuauggagugcauacuaagugcagggcacuguuggguguugagga

SEQ ID NO: 4202501 - RNA, 59 nt, Human
uugucacacccuuuuuuauaccuguggcuauauacuaaauguaaucugggugugugcaa

SEQ ID NO: 4202502 - RNA, 55 nt, Human
uugucacauguaguucauucucaguggugaauuuaggauaaacuaugugugacaa

SEQ ID NO: 4202503 - RNA, 64 nt, Human
uugucaccaugcaaaaugugaaaacuguaauuaacauaaagcauuucacaaaaguaugugacaa

SEQ ID NO: 4202504 - RNA, 58 nt, Human
uugucagggguacuacaugcgaugaggagaagccuagcacgcugugugcaccugauaa

SEQ ID NO: 4202505 - RNA, 101 nt, Human
uugucaucuucuugcaguaauaauucuaugcuaguggaaagcuucuagaaauccaaacagcaguagucaauguauagaggaguuguguaagaggcauucaa

SEQ ID NO: 4202506 - RNA, 61 nt, Human
uugucauuuguaguuaaaaaugucucccucagauagggagucagccaaauuaaaauggcaa

SEQ ID NO: 4202507 - RNA, 76 nt, Human
uugucauuuuagucuauacugucuuguaacagauuguuucacuaucucaaacuacaguauggcugucuuguggcag

SEQ ID NO: 4202508 - RNA, 55 nt, Human
uuguccaagggugcacaacuaguaagugguggugcuggaauuuguacccuggcag

SEQ ID NO: 4202509 - RNA, 85 nt, Human
uuguccaccaagugauuuguggagaugaggacugguaguaacuuagcaaugacuucagaauccagaaucagaauuggagugauag

SEQ ID NO: 4202510 - RNA, 97 nt, Human
uuguccacucucucuuccaacuuucuccuccggcuugcuguggcucaccgccccuucgaaguuaggcuggggguaggaauugaggagugggugccga

SEQ ID NO: 4202511 - RNA, 73 nt, Human
uuguccagcagguguuugccaacuugaagagcuaccuacuaucacagaccuauaaaaguacgccuguggacag

SEQ ID NO: 4202512 - RNA, 60 nt, Human
uuguccaggcucagcacuugcuacuggcuucccagagcagaguggcuguagcuugcucaa

SEQ ID NO: 4202513 - RNA, 66 nt, Human
uuguccauacaguggcacacaucuuuguuuuauacucacugggaugauuugccauuauauugucaa

SEQ ID NO: 4202514 - RNA, 63 nt, Human
uuguccuaauuuauggccuggaucccuacacuuucucuggaccagaggucauccugaggacaa

SEQ ID NO: 4202515 - RNA, 72 nt, Human
uuguccuccaguugcgaacuuggucccgucagggugaauaucaacugaaaaaaucggcuugccuggaaacaa

SEQ ID NO: 4202516 - RNA, 58 nt, Human
uuguccuggcccaaaugucaacauuuuguuaacauugauaguuugaugguuaggagag

SEQ ID NO: 4202517 - RNA, 57 nt, Human
uuguccuuaccucaaucuggaaugggagauucccaucugucagaucaggaaggauaa

SEQ ID NO: 4202518 - RNA, 66 nt, Human
uugucgacacugcauggaugauggcuguagucacugcuuccuuuuacugugcagugauuuggacag

SEQ ID NO: 4202519 - RNA, 72 nt, Human
uugucguucugggaacagccuggcugugucgcuauuucaaacaaagacauuucauguuuuccagagcagcag

SEQ ID NO: 4202520 - RNA, 71 nt, Human
uugucucugagcaugccauauugcuuuuguuacaacucaucaaaaugucccuucuuuggugcucagaguaa

SEQ ID NO: 4202521 - RNA, 76 nt, Human
uugucucuguuauuuccagggucagguuccuucaucuucaauuacuuagucuuaccgugauauauaacagagucaa

SEQ ID NO: 4202522 - RNA, 88 nt, Human
uugucugucuauauuugaaagagcugauacaugaaguuaugcaaacuucauucauaugcuuuguuagaguuauagaaaaaaaagauaa

SEQ ID NO: 4202523 - RNA, 64 nt, Human
uugucugucugucuuuuucuuuccuuucuccugggucaggcaggaaguuaaggcagacagacag

SEQ ID NO: 4202524 - RNA, 99 nt, Human
uugucuucugcugcccacaaaucuaaccucccuaauuaggaaccguauuauuuauguauguauccugaggaugguugaagugcauggcaggcaguacaa

SEQ ID NO: 4202525 - RNA, 61 nt, Human
uugucuuucaaagcuguaguagauuuucccccucauagaauccaucagcuuuugaagagga

SEQ ID NO: 4202526 - RNA, 69 nt, Human
uugucuuuuauuuucuaugaagugcaauuaacugucagauacauuuguugccauucauggagaaggcag

SEQ ID NO: 4202527 - RNA, 87 nt, Human
uugugaaaucaucauuccuuguaaaaaucuuaugaauggcaaggaauuccuuacccuucaucagauuuugggguuuugguuacaugg

SEQ ID NO: 4202528 - RNA, 84 nt, Human
uugugaauaucaaaugaguguacgugaaaguagauauauaaguuauuauguucaauguuuauauuucuucguucauucucacag

SEQ ID NO: 4202529 - RNA, 110 nt, Human
uugugacauagguacagauauuaaugcuggacucucagcuuugaugugaggaucaaacaugagcauuaagccuggcucagaggacauagcaaaugugaguuccugcacaa

SEQ ID NO: 4202530 - RNA, 91 nt, Human
uugugacccagggugagcugguuagagggaggcuggaggugaguuucgcaaccugcagccuuggcaaccagggacuguacucagggaacaa

SEQ ID NO: 4202531 - RNA, 109 nt, Human
uugugacucuguugguuuuccagcaaguaauuugcccugacuuaauguuugguguuucugcuucaggaguaaagaagacuugaccuggcagauuaauauuugaucacaa

SEQ ID NO: 4202532 - RNA, 109 nt, Human
uugugagaauucaguugaauuggauaacuuauguaaaguacaagccucauuacaaacaaacuguaaaagguuguucuuucguuguccccuuucucuaguuucuucacaa

SEQ ID NO: 4202533 - RNA, 60 nt, Human
uugugagcaugugcagccucugcccgcgccugccugccugcccgccugcccagcucacag

SEQ ID NO: 4202534 - RNA, 87 nt, Human
uucugugcccucuuuguucaggcugcuggcuucugggaggacagacuucaaaaaggccugguggccugcagaggccgagcacaagga

SEQ ID NO: 4202535 - RNA, 87 nt, Human
uucugugggcacagccaaaggcacacauaccuuucugcaauuguaagcaagacugggaguaugccucugacuccugagcccacagaa

SEQ ID NO: 4202536 - RNA, 95 nt, Human
uucuguguugccagccuggcuuucagacugugcucuggugaugucguuucgcuggagagggcagagaucugagugggcagagugggcagauggga

SEQ ID NO: 4202537 - RNA, 65 nt, Human
uucuguguugcuuuaucauuaaaugauggucaaugccgaccaucugcuugaaugagcaacaggaa

SEQ ID NO: 4202538 - RNA, 71 nt, Human
uucuguguuucuguaaguggcaaauaauggcaggaccucugcacauuuagcagacuguauagaaauuagaa

SEQ ID NO: 4202539 - RNA, 70 nt, Human
uucuguuagaagguaugauaggaaggaaacaacagguguagauccuuauaucuauaguuuugcagcagga

SEQ ID NO: 4202540 - RNA, 68 nt, Human
uucuguucaccucuauuuuguuugugccauggcaauuucuucaaggaagacuagaccagugaauagga

SEQ ID NO: 4202541 - RNA, 60 nt, Human
uucuguuuuauagagauuuggcauauuugauauauguucuuuggaauuuaugaaauagaa

SEQ ID NO: 4202542 - RNA, 107 nt, Human
uucuuaaccccaggugaccacuaaucuguucuccauuuuuaugauuucaucauuucaagaauguuguagaaauggagaacagauuaaugguugccaggggauaagga

SEQ ID NO: 4202543 - RNA, 86 nt, Human
uucuuaagaaccuugugagucucccaugcgugucauguauauucaugucauccaacaagaggcucuuggcaggucuuuccuaggga

SEQ ID NO: 4202544 - RNA, 80 nt, Human
uucuuaauugaugacugaagccugagcuuuuuuauuaucuaauguuccaugaaaggcucuauuguuuucauauuugagag

SEQ ID NO: 4202545 - RNA, 62 nt, Human
uucuuacaugccgaugacuucuuaaugaaaguccaccuaagaacuaucucuggcuguaggag

SEQ ID NO: 4202546 - RNA, 70 nt, Human
uucuuacuggcauggacuuccucauggacugcuacuucauggaugauagcuucauugcuuuggguaggga

SEQ ID NO: 4202547 - RNA, 96 nt, Human
uucuuagaggauugccuuugucuggcugcuuguuuugauggguguaaaacaaauaagauuagaccgagcagcccaacugaaagcgauagcugggag

SEQ ID NO: 4202548 - RNA, 61 nt, Human
uucuuagccauaauuguuuuucccagggacacaagaucgucuuggcauguuuggcuaagga

SEQ ID NO: 4202549 - RNA, 80 nt, Human
uucuuagguuuagcagucuccauauacauuuacaaaucauuaaauaauuugucaugguauuugugagcugcuccggugaa

SEQ ID NO: 4202550 - RNA, 105 nt, Human
uucuuauaucugcuuuaaagcuaucugguucuagaugagaugaugagaccugaugacucagucucauagguuuggaaccagguagcacuaccaagggcuuaagga

SEQ ID NO: 4202551 - RNA, 81 nt, Human
uucuuaucccuucaauaauucaacauuaaugguuuauuaaacagagccuuccuaaugggcuguuauugaccugaugcagag

SEQ ID NO: 4202552 - RNA, 85 nt, Human
uucuuaugccagccacagacuaguagugaguuucuuugguccucuguggaaaaguacuuugggcuauguuugggcuucauaagaa

SEQ ID NO: 4202553 - RNA, 67 nt, Human
uucuuauuccucuguucuggaacaucugucugcuucugagaaauggaacgagcagcaggaucaagaa

SEQ ID NO: 4202554 - RNA, 66 nt, Human
uucuucaacaaggacacuguuaaguaauacuggcuuuaaaaaauacagguacuuuguaaugaagga

SEQ ID NO: 4202555 - RNA, 57 nt, Human
uucuucagauggugagaccucccuucuguggacagucauucaccaaaucuguaagaa

SEQ ID NO: 4202556 - RNA, 69 nt, Human
uucuucagucccacuagccacauuucaagugcugaauaccuacauguggcuaguuuggaccaugaagaa

SEQ ID NO: 4202557 - RNA, 81 nt, Human
uucuucauggcaguggaaugggaugaguugauacuguaaucucuuaacucauacaugccuuuccagccauugucuggagga

SEQ ID NO: 4202558 - RNA, 57 nt, Human
uucuuccaaagcuuccaggagaggacccuucuuugccucuuccagcuucugguagaa

SEQ ID NO: 4202559 - RNA, 73 nt, Human
uucuuccugagaaaauagcauguguaguauuuuuggggacagcaaagcucagcaugcuauuucucgguaugaa

SEQ ID NO: 4202560 - RNA, 101 nt, Human
uucuucuaggcacaaugauuuacuauucacagauucaguguucucuuugacuucauagaacauaacuauugugaauaguaagaauugacuguguauaagaa

SEQ ID NO: 4202561 - RNA, 59 nt, Human
uucuucuccuuccugguuuucaggcauguguguaugcugagggaggaggaggaggaggg

SEQ ID NO: 4202562 - RNA, 90 nt, Human
uucuucuggcuggcacuaauauaucauguuuaagugaggacagcuucccaucaacuaggaacauuuauauuagauagcuaugugagugaa

SEQ ID NO: 4202563 - RNA, 60 nt, Human
uguuuuccacacaguagucaugcaaauaccuuuuuaggauguauacacguguugaaaaca

SEQ ID NO: 4202564 - RNA, 114 nt, Human
uguuuucccccuccuuuuggccuguagucugagcaagcaguguguugcuguugcuauuuuucauuagccccaacacacugcucgcucagauuaagcuuaugguacucauuaaca

SEQ ID NO: 4202565 - RNA, 72 nt, Human
uguuuucuaaaccaaguguccauauuaguacuuuacaguagugagugagaaaagcugggugccuagaaaaca

SEQ ID NO: 4202566 - RNA, 61 nt, Human
uguuuucugaauaaaggcaugagucaaugaguucaaugaguucagcucaguucagugagca

SEQ ID NO: 4202567 - RNA, 58 nt, Human
uguuuucuuggaugugaaacuagggcacuggguugcucuuagguaauacaaggagaug

SEQ ID NO: 4202568 - RNA, 80 nt, Human
uguuuugaacucuauaaguucuugagcucacuaauugaagagauuuuucaggccauagcacagggaaggaauucaaaaca

SEQ ID NO: 4202569 - RNA, 66 nt, Human
uguuuugacauacaugaaaaugcagcuuccauaagaaauggagacaacaaucaugugugaagaaca

SEQ ID NO: 4202570 - RNA, 65 nt, Human
uguuuugcuauaaauggucuaucuuuugagcccagccaauaugguaacugauuauggcucugaca

SEQ ID NO: 4202571 - RNA, 64 nt, Human
uguuuuguccuuuucuauauacccucaaacugagaagguguuucugguggagauggaaagaaca

SEQ ID NO: 4202572 - RNA, 60 nt, Human
uguuuuguuuuguuuucauggcaugauaccugcaaggccaggaaggcugaagccagaaca

SEQ ID NO: 4202573 - RNA, 85 nt, Human
uguuuuuacuccuaacuccaucucugugucugcuuccuaaagaaccugagugaccagcacaaggagguaguguaggguagaggca

SEQ ID NO: 4202574 - RNA, 61 nt, Human
uguuuuuaguaauuagaaaguaauucucugaagcagagaaugcucugguuugccaagaaca

SEQ ID NO: 4202575 - RNA, 66 nt, Human
uguuuuucacuguauguuccauuugguguuccaggggagaaaaaggauaaauacaguguuuaaaua

SEQ ID NO: 4202576 - RNA, 89 nt, Human
uguuuuuugauaccauguugcuuuugggaaaacaugccugaaaguaggcaaguuucucuaaagcaagaacuguaaaacucacagaaaca

SEQ ID NO: 4202577 - RNA, 66 nt, Human
uguuuuuuggguguauaucuucucuguaauacaggggaguggauuauguggacccaacagaagaca

SEQ ID NO: 4202578 - RNA, 69 nt, Human
uuaaaaaaaugucuuuaucucauguaacaugaggauuucuccauggacagagaaaggagauuucuguaa

SEQ ID NO: 4202579 - RNA, 68 nt, Human
uuaaaaguguugauugaccgaauaucaguaacuggaagaacugaauguucauuagucaacauuucugg

SEQ ID NO: 4202580 - RNA, 84 nt, Human
uuaaaauaccauugccuggauucuaccacagaacaauuaaauugggauuucugugguuaggauucaggcauggacauauuuuaa

SEQ ID NO: 4202581 - RNA, 66 nt, Human
uuaaaaucacuguuauugaucuuaaagggggagugcuucauuaauguaccuaaauggugauuuuaa

SEQ ID NO: 4202582 - RNA, 67 nt, Human
uuaaaauugcggugaauauuuccaaggacaaacaaaaugcugagggaaugagguacugcaacuuuaa

SEQ ID NO: 4202583 - RNA, 72 nt, Human
uuaaacaagauagcuuagaagauucauauuuauuccaaaugggaggcugaaucucucagaugucgauuuuga

SEQ ID NO: 4202584 - RNA, 72 nt, Human
uuaaacaccacagcagucccuaaaacagaaaagauucccagagggggauauacugcugucagugguguuuag

SEQ ID NO: 4202585 - RNA, 129 nt, Human
uuaaacagagcagaccaaacucugaagaagcucuuuucugccucacccagagguuguucccauagagaccacuggaaggcaacggagugagcugacacagaugguugugcgccuauccugucugguuaa

SEQ ID NO: 4202586 - RNA, 55 nt, Human
uuaaacauuuuugaugaucgauucuuauguuugaaucgggucagaauuuguuuaa

SEQ ID NO: 4202587 - RNA, 64 nt, Human
uuaaaccacugaguggagacuaagaaagggaacaaauauucaggguuuuuauaaaguggguuaa

SEQ ID NO: 4202588 - RNA, 95 nt, Human
uuaaaccuugcaggugucagugaugauaugaaagaaucuuuaaucuguuuguguugaaauucccccagaucauuuucacaucuguacauguuuaa

SEQ ID NO: 4202589 - RNA, 64 nt, Human
uuaaagcaaccauuugucucaauucuacguuuuaucagcaugaaagucaauaugguagcuuuga

SEQ ID NO: 4202590 - RNA, 77 nt, Human
uuaaagcagcauucaugaugacaacaggaagacaauuugguucuaucuucuuaugucaagaaugaauauugccuuga

SEQ ID NO: 4202591 - RNA, 61 nt, Human
uuaaaggccaaagugcuccuuuuagaggaaaauacuucuagcacuauacuguggccuuuaa

SEQ ID NO: 4202592 - RNA, 67 nt, Human
uuaaaguauuguuaagauucaacugucauuuaagugcacaguucuaaaucuuggauaauagauuuga

SEQ ID NO: 4202593 - RNA, 102 nt, Human
uuggcagaagcacugcaaagccacaaugaaaucaguuuuaacuuacauugaaggacuuuaauuguuagauuguggugucauugcaaguguuaauucagucaa

SEQ ID NO: 4202594 - RNA, 64 nt, Human
uuggcagagggguuucugguggcggcauccccuagaguccaggccacaggggcuccccugucag

SEQ ID NO: 4202595 - RNA, 68 nt, Human
uuggcagggcagcuuccauagucuggccauagaaccacaggccugagccacuggaaggcccuuuacaa

SEQ ID NO: 4202596 - RNA, 107 nt, Human
uuggcauaucacagguaaaagaaaaccacuaggugucauuauagaccagauacuaucuagguaucauuuuacugugacauuuugguuuccugaaagauagaugcuaa

SEQ ID NO: 4202597 - RNA, 59 nt, Human
uuggcaucaguguaggaccuguuugcaagucagacagauccuugguuauuugugcacaa

SEQ ID NO: 4202598 - RNA, 55 nt, Human
uuggccacaauccaagccuugggugggaugaagccaggccugguucacuggccaa

SEQ ID NO: 4202599 - RNA, 97 nt, Human
uuggccaggauagucuugauuuucugaccuugugauccacccgccuuggccuccccaagugcugggauuacaggcgucagccaccucgccuggccaa

SEQ ID NO: 4202600 - RNA, 77 nt, Human
uuggccauuuuuugcauccugugugugaaaguuggagaacuuggacucagucauaaaaggauguagcagagagccaa

SEQ ID NO: 4202601 - RNA, 56 nt, Human
uuggccccucuuguggcacauacggugggcugugggggcccagaagagagggugaa

SEQ ID NO: 4202602 - RNA, 102 nt, Human
uuggcccuuaacuuuuagaaguucacacauuuaaacauuccaucuugacagauuuacccagcguuugagugucuguggggcuucucuaaagcucagggucaa

SEQ ID NO: 4202603 - RNA, 62 nt, Human
uuggccucaagaaugccaauuacagaugcucugcugucugauuagagcauucuugaguccag

SEQ ID NO: 4202604 - RNA, 64 nt, Human
uuggccuggagaggcgcugcagaggacccugcacaucuggucguucucaguacuuccaggacag

SEQ ID NO: 4202605 - RNA, 76 nt, Human
uuggccuuaaccucucugugccucaguuuccucaucuguaaaagagggauacaguguacagggauaguagugucaa

SEQ ID NO: 4202606 - RNA, 59 nt, Human
uuggcgucuuuuccauggaaagccugcugucuuucucugggcuugggagaagaggccag

SEQ ID NO: 4202607 - RNA, 73 nt, Human
uuggcucaggcauauacucucagaaaaaaauuuucccauaguuuucuuuucucuaagguauugaaugggccaa

SEQ ID NO: 4202608 - RNA, 74 nt, Human
uuggcucaggcuuucauuguaaaugaugguguaaauauccaccaacaguucaggaauaaugaagguggagccag

SEQ ID NO: 4202609 - RNA, 81 nt, Human
uuggcucccaauccccugccgucuccaaucauugcaaugcaaauucgauagaaaagagcugcaggggucccuggcagcuga

SEQ ID NO: 4202610 - RNA, 57 nt, Human
uuggcugccgagcgcaucccggcugcgccccggcggggaggcgccgaggguagcuaa

SEQ ID NO: 4202611 - RNA, 87 nt, Human
uuggcugcuacagguagauacauacuucuaaaaaagccuaagaucacuguucuuagaaguuuugaucugucuugaagaaguagccaa

SEQ ID NO: 4202612 - RNA, 85 nt, Human
uuggcugcuccauguguucucagggaaaauaaaacugcaaccucagauuguagcugugugcccaugguggaggcaugcaggccaa

SEQ ID NO: 4202613 - RNA, 55 nt, Human
uuggcugcuugaaauaagacauuguggcacaucaaccucucuucuuggcagucaa

SEQ ID NO: 4202614 - RNA, 64 nt, Human
uuggcuuagcagcaauggcaucaacuaguugcuaauuagaaaugcccagauucugcuagaucaa

SEQ ID NO: 4202615 - RNA, 61 nt, Human
uuggcuucccagagcuuacgcugacucauuugagaaacagaaaaagugacuggcaggccaa

SEQ ID NO: 4202616 - RNA, 66 nt, Human
uuggcuucuaaauuaguucaauggaugauagaaauguucuuuuguugauggaauuaaugaugcuaa

SEQ ID NO: 4202617 - RNA, 79 nt, Human
uuggcuuuaccuccauucuuucagugucucauguuuucuuaauucugaacaugagaaagagaauggacuugagagugaa

SEQ ID NO: 4202618 - RNA, 67 nt, Human
uugggaaacaguauagcuaacaaacagauuggcuuuggagucagugggcaagcugugcuguuacuaa

SEQ ID NO: 4202619 - RNA, 76 nt, Human
uugggaagaaagggucacugaaagaggagguggcuacucaccugucaagucugcuuagauguugcccugguuccaa

SEQ ID NO: 4202620 - RNA, 56 nt, Human
uugggaagaggccccuggauuccacagagacugguggccaaccgggcagcucccag

SEQ ID NO: 4202621 - RNA, 88 nt, Human
uugggaagcagcucacuaacuucauauaaaggucucuaaucuaauuagaugcaggauuagaaaguugccucugaguugcuuuucucaa

SEQ ID NO: 4202622 - RNA, 76 nt, Human
uugggaagcuguguauuacagaauauuuaggagcaccccugacccaugucugccagauaccagcagcaccucccag

SEQ ID NO: 4202623 - RNA, 61 nt, Human
uugggaaguuaucagaaugcugcuuucccuggcaucgucuuggagggcuugauggacccga

SEQ ID NO: 4202624 - RNA, 77 nt, Human
uugggacuacauuuauagucgucucaguaauaaacaacuauacaacuuuuauuauuguaagggcuauaaguccacaa

SEQ ID NO: 4202625 - RNA, 64 nt, Human
uugggacugaucauuuuugaacccuauuugauauguucuauaucucaaagaagauucagcucaa

SEQ ID NO: 4202626 - RNA, 72 nt, Human
uugggagcaggugugcuagggaagcuaccaauaacuaagagcugaaguuucuaacucuacacuagcuuugga

SEQ ID NO: 4202627 - RNA, 57 nt, Human
uugggcagucuggcugcagagucuggguuuuauucacuaccuguccugacugccugg

SEQ ID NO: 4202628 - RNA, 62 nt, Human
uugggcaguuagccuugacccauaucuuuuaggggucaucuuccuaguguuaacuaccccaa

SEQ ID NO: 4202629 - RNA, 80 nt, Human
uugggcccauaauuuagaugaugugacucucuugcaugggcccuccccauaaagguagugugacauauuguugagcccag

SEQ ID NO: 4202630 - RNA, 94 nt, Human
uugggccuggugccaggguuaaaacugauauuaugggugaucauacagcuugguggcucauuuuagucagucuuuaacaccacagaccucccaa

SEQ ID NO: 4202631 - RNA, 55 nt, Human
uugggcucuuguuaccacugacaugaauuguccagugcuggaccagagcacccag

SEQ ID NO: 4202632 - RNA, 76 nt, Human
uugggcuucuuucgucucggaagucuucucuugaagagaagacuuuaagccgagauuaggaugaagugagggccag

SEQ ID NO: 4202633 - RNA, 69 nt, Human
uuggggaaugaacaaucuguugacuucuguuauuuggaaugaagacauguuguuuguugaauucucugg

SEQ ID NO: 4202634 - RNA, 63 nt, Human
uuggggaaugaggcuacuuuuucagaagaucaauagaaaugggaagagaguccucauccugag

SEQ ID NO: 4202635 - RNA, 72 nt, Human
uuggggagccugugggaugagaugugucagagaagaggccagggcaggaccauuucacacggggcuuuuuga

SEQ ID NO: 4202636 - RNA, 75 nt, Human
uuggggaucauuacagagacauccagaacacagauaagcaaauaugugcguggauuccuguacucauuucucuaa

SEQ ID NO: 4202637 - RNA, 73 nt, Human
uuggggauuagugacauguuauggacuggcuacuuugaguagcacuguucuagcauguuuuuguguacuccaa

SEQ ID NO: 4202638 - RNA, 87 nt, Human
uugggggcaggguaagcaaugucugaccguuuugcccaggcgugucucaaacuccugggcucaaggcaucuuaccucugccucccaa

SEQ ID NO: 4202639 - RNA, 63 nt, Human
uuguucuugucuuugccuucaccuaagaaaauaaugaagggugguaaauaaggauaagaagga

SEQ ID NO: 4202640 - RNA, 95 nt, Human
uuguugauuauugauguaguaguguuuuuuaauugcugcaugacagauuacuaccaucauaguggcuuaagcaacacacauuaauuauuucacag

SEQ ID NO: 4202641 - RNA, 56 nt, Human
uuguugcguugcuugcccauuuguuggacccuagcagggcaaagucaggcuaacaa

SEQ ID NO: 4202642 - RNA, 72 nt, Human
uuguugguaauaaugaaugcuuuauaaagugucucugcaacaaccacuaauuagcuucauuauagcccacag

SEQ ID NO: 4202643 - RNA, 63 nt, Human
uuguuggugaauaggguggaauugggacaaguaggaggagguuuuacccuuuuucauaaauaa

SEQ ID NO: 4202644 - RNA, 61 nt, Human
uuguuguccauugugacaaguguggccucugacuggggccaauuguugcacuuggauacaa

SEQ ID NO: 4202645 - RNA, 57 nt, Human
uuguuguguugauuaucuagacuuauggaagugcuagagaaaauguuaauacaguaa

SEQ ID NO: 4202646 - RNA, 57 nt, Human
uuguuguugcuuaacaguaucuaaaccauuggguaagacacaguauaagcacaacaa

SEQ ID NO: 4202647 - RNA, 114 nt, Human
uuguuuagaaagaguuagcugauauuuccauccauuagucuuaaaacuaagcugacuggaaagaacagcuauagauggacugaagaggaaauaaugcuauaccuucaugaacaa

SEQ ID NO: 4202648 - RNA, 73 nt, Human
uuguuuagcuaauauguggcauggaguaaggauaucauugucacauucaaguuuuauauccauggcuugauaa

SEQ ID NO: 4202649 - RNA, 77 nt, Human
uuguuuauauugguuugaaucauuacaauagauaaguccagaaggauaaguuggugcuugauugcuagucuaaauaa

SEQ ID NO: 4202650 - RNA, 61 nt, Human
uuguuuauuccaccuccauuuuccuagggaaggaauucuaguaaaccgagggaauaaagaa

SEQ ID NO: 4202651 - RNA, 79 nt, Human
uuguuucacgcuuuucuguggauggugagcaaauggcugauucuuuauggcccucagagccccaggaggguguggacaa

SEQ ID NO: 4202652 - RNA, 111 nt, Human
uuguuucagugugggaguagugguggcuggaagucagaaaugggaaagagguuucuucucccuucuuugccuucugaauuuuaguuuucuggggcucccauuucucugcaa

SEQ ID NO: 4202653 - RNA, 73 nt, Human
uuguuuccauaauaacugacuuguauaaaggccauuuuuaaaggccauuacaggacagauguuuacaggacag

SEQ ID NO: 4202654 - RNA, 79 nt, Human
uucuuuuagucauucagggaagcugauuauacugacaaaaaauaaguauguuuguuaucuucugggccacuaaaaugaa

SEQ ID NO: 4202655 - RNA, 110 nt, Human
uucuuuucccuuaaauguucucugucuuuaauuuuacuaugacuggggaccuuccagggccagacauuguguaagaugcugggauagaugacuuagauguggucaaagaa

SEQ ID NO: 4202656 - RNA, 64 nt, Human
uucuuuuccucaucuguaaaaugggggaaacaauaauauuaauccaugaguuugaggaaaagag

SEQ ID NO: 4202657 - RNA, 89 nt, Human
uucuuuucuuuucauuguaaccucgcccucccauugauaauugguugccuaaccaauucaucuggguagguagccugaacaguugagga

SEQ ID NO: 4202658 - RNA, 69 nt, Human
uucuuuuuucugugcaguucuugucuugacuuaugaaagccaaauauccauucuguauggggagaugaa

SEQ ID NO: 4202659 - RNA, 66 nt, Human
uugaaacaauuaccuuaacucuuaacccuucuuugggccaacugaguugcugguaaauguuaucaa

SEQ ID NO: 4202660 - RNA, 84 nt, Human
uugaaacucaggucccuuggaggaagcucuaggcucugaaauuacuucucucggccucaguuucuccauggguuuuggauucag

SEQ ID NO: 4202661 - RNA, 111 nt, Human
uugaaauaguuuauuuguccacagugugauuucuguugagaaacaugggcucaccgacuuuugggucucuucuaacacuagaaauuccucugguuuuuuagacuauuucaa

SEQ ID NO: 4202662 - RNA, 59 nt, Human
uugaaauguuuaucucuccugcugaggguaucucagccuugguaugauugacauuuugg

SEQ ID NO: 4202663 - RNA, 79 nt, Human
uugaaauuccauuguuucuuagcagugcugagaagaaugaggaaaguauucuuccuccacgcugggaauggauuuucaa

SEQ ID NO: 4202664 - RNA, 86 nt, Human
uugaacauuuuucuccccagggguauggguauuauguucacacauaagucacauuuuuaacccuuuuaggaggagccaaaugucaa

SEQ ID NO: 4202665 - RNA, 59 nt, Human
uugaacuguaagcaugucugcccuuugcucuggagggagauacuaucuuuacaauucaa

SEQ ID NO: 4202666 - RNA, 67 nt, Human
uugaacugugucuuccuguccuaccucuguguaccuuuuuagaggugugaagaguugacacauucag

SEQ ID NO: 4202667 - RNA, 64 nt, Human
uugaacuuuguguauaccuuguccugguaaauuuaauggacaucucauuuauacagaaguucag

SEQ ID NO: 4202668 - RNA, 56 nt, Human
uugaagacacagacauauagaggcuccaccuacuuauuauauugcugugucuccag

SEQ ID NO: 4202669 - RNA, 90 nt, Human
uugaagaucagagggagcacaguggaagaagcacugaacuuggaauaagaaaacucccaguuccauccuuccacugcccugugaucucag

SEQ ID NO: 4202670 - RNA, 63 nt, Human
uugaagaugcugucucuuccagauccuucaagauuggaaaaagaaggugaugagcauuuuuaa

SEQ ID NO: 4202671 - RNA, 129 nt, Human
uugaagauguuauauuaaaauaugccauuguaaguugaaacauuuuugcauaaauuuuuaaaauucucauauucagagaaagaaguaugugagaaauuauccauaaaguggcugauauggcauucugaa

SEQ ID NO: 4202672 - RNA, 64 nt, Human
uugaagcagaguuagcuugucaccugccucccuuucccgggacaacagaagcugaccucuuuga

SEQ ID NO: 4202673 - RNA, 59 nt, Human
uugaagcucuaacuuccaauaccucagaaugugacuguauuugaagacagggucuuuaa

SEQ ID NO: 4202674 - RNA, 70 nt, Human
uugaaguacaaauuuugaagagcuugcuucuguuucuauuuuagagaguuacacaaaauuucuauuucag

SEQ ID NO: 4202675 - RNA, 59 nt, Human
uugaauaacuuuuaaaagacccuggugaagcaccauggaauauucuaugaguuauucag

SEQ ID NO: 4202676 - RNA, 129 nt, Human
uugaauagguuaugugagaggugacuggguuauuugggaggugacugguuuaucuggcagugacuggguuaucuggggugaauagguuaugugagaggugacuggguuauuugggaggugacugguuua

SEQ ID NO: 4202677 - RNA, 106 nt, Human
uugaaucuaauguuuguagaaagauucauguuagcccacauguagaacucgauuuauaggcaagagaccuugaaacucuuugaauucaaauguuggaagccuucaa

SEQ ID NO: 4202678 - RNA, 65 nt, Human
uugaauggcacaagaguaaacuguuguauuacuucacacagcagagcuauucuugugcaauuuga

SEQ ID NO: 4202679 - RNA, 64 nt, Human
uugaauggcuguaguuaccugaugaaauaauaaguuauuaauuccagaacuuugcagcccucaa

SEQ ID NO: 4202680 - RNA, 99 nt, Human
uugaauguugcaucaggcacuagaguugcaaaagauucuccgucaaucagaaaggggcaggagaaugauauauagcucagugagaugauguaaacucaa

SEQ ID NO: 4202681 - RNA, 58 nt, Human
uugaauuguuguggaacagugcagucacauuuuaugcaagguuuguacaacauuuuaa

SEQ ID NO: 4202682 - RNA, 76 nt, Human
uugacaaacacgguggcucacagcaauguuuccugguaauaaguucguuguuugugagucacgauggauuuggaaa

SEQ ID NO: 4202683 - RNA, 78 nt, Human
uugacaaguucuugaagacuuuaaauagcaagcaagggagaaaugguuuucuguaguauauagaguuagaacuugcag

SEQ ID NO: 4202684 - RNA, 70 nt, Human
uugacacuaaacagagaucuuaauuccuguaucuucaugcaucagaauuuggucuuaguggagaugucaa

SEQ ID NO: 4202685 - RNA, 67 nt, Human
uugacagcagaauccauucccaguuaauuauuauuuuaauacuugauggugucugucaaauugucga

SEQ ID NO: 4202686 - RNA, 101 nt, Human
uugacagcggcagauauuuuugaauaugauugcaaauuuggcuugucauggaguaccugccaaguaccaugaauguauuugaugaauaauucugcugucaa

SEQ ID NO: 4202687 - RNA, 57 nt, Human
uugacaucuuugaucucauuuagacccagagauggggcugaauuuauuggauguuaa

SEQ ID NO: 4202688 - RNA, 58 nt, Human
uugaccacuaggaauaucuuaccacaagaacguaucugucagugggaccuguggccaa

SEQ ID NO: 4202689 - RNA, 77 nt, Human
uugaccagcuguaugauggauguggcucuggagcugcucccaggcaggguucagccccaagagccucaucuggucaa

SEQ ID NO: 4202690 - RNA, 106 nt, Human
uugaccagguuaaaagagcugccaugacuccaggccaaguggucaucucaggugcuccuugugcauauagaguuagauggcuggaguuccucuuagccaggauuaa

SEQ ID NO: 4202691 - RNA, 57 nt, Human
uugaccugggcacagugagcaugagauacauuuuguuguaaucgcuguuuaggucaa

SEQ ID NO: 4202692 - RNA, 92 nt, Human
uugacguucccuagcaugcaaaguaagucaugcaugaacggugcacaauaauucuuguuuugcuuugauguguuaguucuuaaggauaucaa

SEQ ID NO: 4202693 - RNA, 87 nt, Human
uugacuaaaucuauguugaaauuuuuuagaaaaucuggaagcucaauaggcuuccucagcugagagaugauauagcuuaaugguuaa

SEQ ID NO: 4202694 - RNA, 59 nt, Human
uugacuauacucuggcggaaaaaggagacaaugucuucaauuccucaggugugaguuag

SEQ ID NO: 4202695 - RNA, 55 nt, Human
uugacuucagaauguugaugguagcaucaacuguuuuaccauccucugaaguuaa

SEQ ID NO: 4202696 - RNA, 75 nt, Human
uugacuugcuaaaaguaaacugucuacucugugcuagccauuauaaugggugcuagggauauaguggcgagucaa

SEQ ID NO: 4202697 - RNA, 82 nt, Human
uugacuugggaaagaugucucaaagacaucuccugcuuguaaaggcagguguuuuaagacauugaacccauccuuagguuaa

SEQ ID NO: 4202698 - RNA, 67 nt, Human
uugacuuuuccacuguagagauguugaaguuaaaauaauuucaacaucuuggagcuggaacauacaa

SEQ ID NO: 4202699 - RNA, 67 nt, Human
uugagaaaagcuguguaaggaucauguuacauacauugugcuuucucuuacagaguuaccuucuuaa

SEQ ID NO: 4202700 - RNA, 96 nt, Human
uugagaaauuauugcaccugucucuguguugggacauuuuuuuggucccagguaguuggaagagacaaagcuguaaauuauuuacuaguuuuucaa

SEQ ID NO: 4202701 - RNA, 65 nt, Human
uugagaagauugggcagaguggaguuucaacaaugacuucugucacccuuccuuagucuuuucag

SEQ ID NO: 4202702 - RNA, 102 nt, Human
uugagacagagucucgcucugucacuaggcuggagugcaguggcgugaucucggcucacugcaaccuccgccuuccggguucaagcgauucuccugucucag

SEQ ID NO: 4202703 - RNA, 95 nt, Human
uugagacagagucuugcucugucacccagagugcaguggcacaaucucggcucacggcaaccucugacuccuggguucaagugauucugucucag

SEQ ID NO: 4202704 - RNA, 104 nt, Human
uugagacagaguuuugcucuuuuugcccaggcuggagugcaauggcgugaucucagcucauugcaaccuccgccucccagguucaagcaauucuccuaccucag

SEQ ID NO: 4202705 - RNA, 100 nt, Human
uugagacagggucucucucugucucccaggcaggagugcaguggcgcaaucacagcucacugcagccucuaccuccugggcucgaguuauccugucucag

SEQ ID NO: 4202706 - RNA, 98 nt, Human
uugagaccaugaguuuuggugucuuucuaaauguuccuugauuaucuuuaaagguguuggaaauauguaggaacucauauuuaaacuuaggguuugga

SEQ ID NO: 4202707 - RNA, 122 nt, Human
uugagacgauuagagaucaugguuauuagauaagccucaggaggauguuuuucuuggguugcucacaagcauuuugaaagagucguguuccagguuugagaucccauguuucuuccucuuaa

SEQ ID NO: 4202708 - RNA, 103 nt, Human
uugagacggaaucucacucugucgcccaggcuggagagcaguggcacgaucucggcucacugcaaccuccaccucccggguucaagugauucuccugccucag

SEQ ID NO: 4202709 - RNA, 102 nt, Human
uugagacggagucucacucugucgcccaggcuggagugcaauggugcuaacucggcccacugcaaccuccgccucccggauucaaggauucuccugucucag

SEQ ID NO: 4202710 - RNA, 56 nt, Human
uugagacggaguuuugcucuuguugcucaggcuggagugcaauggcucagucucag

SEQ ID NO: 4202711 - RNA, 76 nt, Human
uuucaugaagguaguauauauccaaaaugcauuacuuugucuugacuuccuuuggauauguuucugucuucuggaa

SEQ ID NO: 4202712 - RNA, 67 nt, Human
uuucaugggguuguacugaaugggaauauguaaaguuucauuuguuauuuacaacaauccuaugaga

SEQ ID NO: 4202713 - RNA, 108 nt, Human
uuucauuagacuuguuuugaaacucaugaucaucacuguaaauaccucuguguggaaagcaaugaaauaaaaccaaaagaaguagugaagucauggcaagcugugaga

SEQ ID NO: 4202714 - RNA, 58 nt, Human
uuucauuagccuucacagagcacuuuguauagagugaggcacagaguggcuggugaaa

SEQ ID NO: 4202715 - RNA, 130 nt, Human
uuucauucacaaguggacuaaguaaaagcauacagcagggcgcugugaugaacacgcuuuaagguggcuucaacuccuggugcucaugccccgugugugugauuugcuucuaacuaguagaauauggaaa

SEQ ID NO: 4202716 - RNA, 56 nt, Human
uuucauucuuugaaucugagguagucauaugauugacuuuggccaguugaaugaaa

SEQ ID NO: 4202717 - RNA, 92 nt, Human
uuucauuugacaggagccaaaauaggauaauagcgccaacaguuuuuuaaaugaaguccuaauuauggcucauagucucacuuaugaugaga

SEQ ID NO: 4202718 - RNA, 70 nt, Human
uuucauuuuacgcuuauaggacagccucuuuugcauuugaaugagacuaccuguaauguggcaaauggaa

SEQ ID NO: 4202719 - RNA, 58 nt, Human
uuucauuuuucugcgaguagcauguguguauuacacugcuucagucagagaaauuaaa

SEQ ID NO: 4202720 - RNA, 76 nt, Human
uuuccaacacauuccagugaaucacaguuagaugccagacuggcagacgugacacauucuggacaugguuaggaag

SEQ ID NO: 4202721 - RNA, 79 nt, Human
uuuccaagucuagcaaauagaauucagaaagggaauaucgucucuguuauucugucuauugccauaagaauccaggaaa

SEQ ID NO: 4202722 - RNA, 55 nt, Human
uuuccaauaaggucaccuuccuagguucugggauuaggacauaucuuauuggaga

SEQ ID NO: 4202723 - RNA, 81 nt, Human
uuuccacauccuuugugucccaugcggccuacacuccagggagguggcacaaggcuuacacagcagcaggcaauguggaga

SEQ ID NO: 4202724 - RNA, 130 nt, Human
uuuccacccaaauuauuguaguuuuugucauuuuugguguggcugaagguaugaguuuuaucuuggaaguccaaagcuggaaaaaauuccaucucaguuccaguuaaagugagaaaugcuauggaggaga

SEQ ID NO: 4202725 - RNA, 86 nt, Human
uuuccacuaaguggaccagaagacugaagcucacauaagcuacaagccuugcucaagccucuuuuucaagguccacaagguggaga

SEQ ID NO: 4202726 - RNA, 70 nt, Human
uuuccacuacgucugcaucugacuggucauuuugggauccucuggccaguagauaggcaggcaaaggaaa

SEQ ID NO: 4202727 - RNA, 72 nt, Human
uuuccacugagccaggagcaauaucauccaugaaaagaugagauggcgguguagcuaggcaagaacuggaga

SEQ ID NO: 4202728 - RNA, 85 nt, Human
uuuccagauuucucaaauugcaugaguagcuugcaagcugacauaauuaugcugcucucauuagcaauuuaaguacagcuggaaa

SEQ ID NO: 4202729 - RNA, 60 nt, Human
uuuccagcuucaaagaacaaagggaggcuuaauggcuuuuaugcuguaguuugaaggaaa

SEQ ID NO: 4202730 - RNA, 65 nt, Human
uuuccaggugguuugauaggauaacucuucagagaguuuaacuuuggaaaacuauauucuggaga

SEQ ID NO: 4202731 - RNA, 55 nt, Human
uuuccauaaucucuuggggaguggcaggaaugaauuucucaccaugguauggaaa

SEQ ID NO: 4202732 - RNA, 56 nt, Human
uuuccaucaguggagagcauuauaagacgugagcuuuagaaauaucacuguggaaa

SEQ ID NO: 4202733 - RNA, 72 nt, Human
uuuccaucucuucuuuugcuucccugacuuugccaugagaacacguccaggcuagccugguagagaaugaaa

SEQ ID NO: 4202734 - RNA, 101 nt, Human
uuuccaugggggcucagccauguugaagcauguaugucaaacugauguaagaguuugacagaaauguauuugcaugaauugcugaagagccuccugagaga

SEQ ID NO: 4202735 - RNA, 89 nt, Human
uuuccaugugcuucaccuuugcagcuccauuuuaauggcuggacaugcuuagcuucucagauggacuguuaguacggccauuauggaaa

SEQ ID NO: 4202736 - RNA, 107 nt, Human
uuucccaagcauuuucuccuucauguuccucccuguaugcccugugcaaugguguacagccuggcacuacccuggggggaggagaguuaaucaggcugacaaggaag

SEQ ID NO: 4202737 - RNA, 55 nt, Human
uuucccagaauccuguucuguauuugacauuucuugcagagaugggaguuggaaa

SEQ ID NO: 4202738 - RNA, 55 nt, Human
uuucaaauggagucgugaaaugaagggcacccuucauauccgauuguauuggaaa

SEQ ID NO: 4202739 - RNA, 57 nt, Human
uuucaacauaccucaguguauguacauuguauaaaacauugaauguaugugaugaaa

SEQ ID NO: 4202740 - RNA, 70 nt, Human
uuucaacauugauugagcacccauuauguaaacuagacauguauaugauuggcugcuaucagugaaggaa

SEQ ID NO: 4202741 - RNA, 62 nt, Human
uuucaagaagcaaauuaaaguccacauguuuagugaacuucucaguguuugucuucuuggga

SEQ ID NO: 4202742 - RNA, 79 nt, Human
uuucaagaguuaacgcaugguuucucugcugaugguggcauaucccagggcaaaugagaucauagcauuaaugaggaga

SEQ ID NO: 4202743 - RNA, 56 nt, Human
uuucaagcuccagggucuauguuuggaucuuuaucaucagccuugaaugcuugaaa

SEQ ID NO: 4202744 - RNA, 59 nt, Human
uuucacaaaggaaaagaacuguaugguccauaaugacagucuuuaauuucuuuguggaa

SEQ ID NO: 4202745 - RNA, 68 nt, Human
uuucacaagacagucuuggauuccaggagucauguccugauuccugcuauucacagggcuaugugaaa

SEQ ID NO: 4202746 - RNA, 63 nt, Human
uuucacauuggcaaacgggguugcaaagugcucuucgugcucuuuggacagugccuuguggag

SEQ ID NO: 4202747 - RNA, 62 nt, Human
uuucacauuuuauacuuaagccuauuuuccauuuugaguuaauuuuuguaugaggugugagg

SEQ ID NO: 4202748 - RNA, 74 nt, Human
uuucaccuaucgaucuuugaauaauuagaagacauuguacaaucaauguguuuauuuagugauuuauugugaga

SEQ ID NO: 4202749 - RNA, 62 nt, Human
uuucacucccucguuuuuccucucagagagaaaaaaauuagggaggaaccacugggaggaga

SEQ ID NO: 4202750 - RNA, 60 nt, Human
uuucagaaacgauuaugaacacgauuuuaagaaguauaaaugucauuauuguuucuggag

SEQ ID NO: 4202751 - RNA, 58 nt, Human
uuucagagagaucaacauagcuuacauuuuguuauggcuaugguugguuguucugaga

SEQ ID NO: 4202752 - RNA, 61 nt, Human
uuucagcauuuuugcugcugcccacuauucauaugggugguaugagcugaaauugcugaag

SEQ ID NO: 4202753 - RNA, 67 nt, Human
uuucaggcagaaaaaucacuaauuuccacauuuaaaggaaaaauaauuggugcauucugucgggaaa

SEQ ID NO: 4202754 - RNA, 64 nt, Human
uuucaggccucuaaagggaaagcauuaagauccuagucuuggcuuucuccuuauaggccugaaa

SEQ ID NO: 4202755 - RNA, 70 nt, Human
uuucagggauauguuaagcauuugagcuaaaaauuauaccuuugguugaaacauaaaauauuuccugaaa

SEQ ID NO: 4202756 - RNA, 73 nt, Human
uuucagggcauccagaaagacacauuaaccaaagacugcugaaugcuuugggagagaauucuggugacugaaa

SEQ ID NO: 4202757 - RNA, 75 nt, Human
uuucagggcuuuucuugugacuaucgaagggucaacaggugugauucuucacaaauauauagaaggguuguggaa

SEQ ID NO: 4202758 - RNA, 89 nt, Human
uuucagguucagugacuuuucccuugcaacaaagggaggcucaagagaccuuguuuuggaaccaaaggauguuauugaaccuuuugaaa

SEQ ID NO: 4202759 - RNA, 67 nt, Human
uuucagucaccaacaugguucccaggggucuaggcuguggccucugcuggagcaaguggugaggaga

SEQ ID NO: 4202760 - RNA, 111 nt, Human
uuucaguccaauaauagaggcaagauucggggcccacgaugcauuucauuuacuuuuggguaauaaaccaggaaugucaaguagaugugcgugggcuucgaugacaugaaa

SEQ ID NO: 4202761 - RNA, 56 nt, Human
uuucaguugcagugguugucuaacaguucugcuguauggacauuggcaaacugagg

SEQ ID NO: 4202762 - RNA, 71 nt, Human
uuucaguuuaagacaaggggguguaguggggaauuaucguguaaaacuacaccaguaucuuaagcaugaaa

SEQ ID NO: 4202763 - RNA, 71 nt, Human
uuucauaggaagaagcagccuugcuuaaauugagaaagucagacugaacaaaacaugguucuuccuagaga

SEQ ID NO: 4202764 - RNA, 76 nt, Human
uuucauaguuguuuuucugggguuacuuagaauuugagaguccgugagaagcauuaggaagaacauuacugagaaa

SEQ ID NO: 4202765 - RNA, 80 nt, Human
uuucaucagauggauuuauacuauuucuggaaugcugccuuucauuuacuuugagguggauaaaaccuaaucguuugaaa

SEQ ID NO: 4202766 - RNA, 114 nt, Human
uuucaucuuuauaguuccagauccagcuaagauuacacucugguugcgugacugaacaaaucuguuugcagggagagaugugguguuggaauugugaaccuauggagaaugaaa

SEQ ID NO: 4202767 - RNA, 67 nt, Human
uuucauuuauauauugcuuacaaguacgugguaauuugaacuucaguaggugauaugugcaaggaga

SEQ ID NO: 4202768 - RNA, 76 nt, Human
uuucauuuaugagcugaaccaugaaacuugcccuuaucuacuauugguuucccagugguacaguuuauauaggaaa

SEQ ID NO: 4202769 - RNA, 83 nt, Human
uuuccaacacaguaacuccugaccccucgcagucugagaaguggugguaaguagugguggguaagaguugagguguugguaaa

SEQ ID NO: 4202770 - RNA, 71 nt, Human
uuuccaaccccauggaugaccugcuuguuucaaacaguauuuguaaaacaagcuuuaugguucccuggaga

SEQ ID NO: 4202771 - RNA, 59 nt, Human
uuuccaacuguaccccaguguuuaugguaaagugguaccaggaauuggacaguuggaaa

SEQ ID NO: 4202772 - RNA, 64 nt, Human
uuuccacaauguuuuugcaggaaaaaacuuucaaacauuuuagugcuaaaaacuuugugguaga

SEQ ID NO: 4202773 - RNA, 129 nt, Human
uuuccacugccccuuccacaauucagcauguuucaagaggcugaagcaaauagauugaaugaacacuacacauccauagcauucauugucucuguuugccuucagcccaugcucuguucugagaugaaa

SEQ ID NO: 4202774 - RNA, 87 nt, Human
uuuccagaauaaaacuguaaguuugaggggaaaguggauauuuggucucaguuuccaccuucacuuucacuuuaaauagccuggaag

SEQ ID NO: 4202775 - RNA, 101 nt, Human
uuuccagauagcauuuaguugccucaagauuuuuuauugauacaucuuuccccaugauucaauguuuguuuuugaugguaaguguauuuuaucuuaugaag

SEQ ID NO: 4202776 - RNA, 83 nt, Human
uuuccagauccucuuauugcauauuguacuugaauggacucucauugccaaaguuuugauuaaguaaaugucguaacuggaaa

SEQ ID NO: 4202777 - RNA, 59 nt, Human
uuuccaggcagaggaguugugauaaugaggauuaaggcauacagccuauugccugggag

SEQ ID NO: 4202778 - RNA, 64 nt, Human
uuuccaguaaguggcaaggagcuuaauguacuaauauuuucauguuuuguccaccugcaggaag

SEQ ID NO: 4202779 - RNA, 82 nt, Human
uuuccagugauaaauaagacugaauucuaaaugugaugagauaccuguccauuauagaggguuacaguuaauaacauggagg

SEQ ID NO: 4202780 - RNA, 64 nt, Human
uuuccauacguuuccacuguuugaucugugagaaagacuaggggacaaggcaggagauuggaga

SEQ ID NO: 4202781 - RNA, 123 nt, Human
uuuccaucuccucuugaguucucuaaauuauguuuggcaguaagcaaaaguuaauacacugccugaugugguucuaaauuaauagaagaaauauuuaagacaauuauacacaggggaaagaaa

SEQ ID NO: 4202782 - RNA, 75 nt, Human
uuuccauuuguuauguucuaggaugugugugcauaacaagauguacaauguaauucugauuauguuaaauugaaa

SEQ ID NO: 4202783 - RNA, 58 nt, Human
uuucccaacugggcccuccagugggucuguuuuucuauccaggugcucaaaugggaaa

SEQ ID NO: 4202784 - RNA, 59 nt, Human
uuucccaggcaaggacaugaaacugaggaagagaauucaccaccuacuugccugggagg

SEQ ID NO: 4202785 - RNA, 75 nt, Human
uuucccagucacugcuuugucccuguguggcccacagaagggcuguguucugacucagugaguggaggugggaag

SEQ ID NO: 4202786 - RNA, 63 nt, Human
uucaccauguauuuauugagugcugucuagcacuaugggaggcacugaagcuacaauggugag

SEQ ID NO: 4202787 - RNA, 59 nt, Human
uucacccugcuggaggcagcugacucagaaaccugaggaaugcaucuugcaugggugag

SEQ ID NO: 4202788 - RNA, 94 nt, Human
uucaccucuagccuuuucuguaagaggacuuuaauugacuuaagccaauugguauauucccucucugcagagauauuuuuggcccagagaugaa

SEQ ID NO: 4202789 - RNA, 83 nt, Human
uucaccuugcuuuuuucccacaugcuauuccaccauuaucagaaaaagauuggcauauuuacaaggaagagaggaaaggugga

SEQ ID NO: 4202790 - RNA, 130 nt, Human
uucacgcacuauggaaucccugcuccuuucagagccuccaggcuccugacuuuuugggacuccugguuccaugaggcagggaggcuggcucuucccucugaggacacugggucugggaugcagugcugag

SEQ ID NO: 4202791 - RNA, 58 nt, Human
uucacucuggcuagggcauagagcgcgaacuagguucucagacccgaagccagaggaa

SEQ ID NO: 4202792 - RNA, 58 nt, Human
uucacuggggcccacaucaacauggaaccaggcuaugguuuguaagguccccagagaa

SEQ ID NO: 4202793 - RNA, 77 nt, Human
uucacugugcucagcucuauggacacaaagaugauuuagaagcagcuguugucccugggagcucagccagcagugaa

SEQ ID NO: 4202794 - RNA, 67 nt, Human
uucacuguucuucugggaauggcccugcagccuccuugcgggaggggcugccuagaagaggagagaa

SEQ ID NO: 4202795 - RNA, 87 nt, Human
uucacuguuguauccccagcaucuaguacaacuacugguauauaauaaguacacaguaaauauguauugaaugcauagacuagugaa

SEQ ID NO: 4202796 - RNA, 67 nt, Human
uucacuuccugcucugggcucaauggcagcuccagcugggguccaggagcccaugagagacuuugaa

SEQ ID NO: 4202797 - RNA, 75 nt, Human
uucacuucuguugccuugugcaaugcugaucuccacuuuauugugauugccaaaugcaagguaaaagagcaugaa

SEQ ID NO: 4202798 - RNA, 58 nt, Human
uugauuuuacugcugcugaaaacugucugaagaugagaagcaguuucaguaagaacaa

SEQ ID NO: 4202799 - RNA, 90 nt, Human
uugauuuuguuggagugaggucaaagccuuggguauauaaagcaauuaauaccuuuaggcauuuugcaucaaucacuggagcaucaucaa

SEQ ID NO: 4202800 - RNA, 68 nt, Human
uugauuuuucuuuaaacuuauuaauuagagucagcgucuucucugauuagcaguuuagggaaauuuga

SEQ ID NO: 4202801 - RNA, 70 nt, Human
uugcaaagagauuguuuuaaauaccaauauaccaauugguauaaaaagaauuuagaaggaaauuuugcaa

SEQ ID NO: 4202802 - RNA, 63 nt, Human
uugcaaaguuugcucaaaugagggaagccagcuacuuucacaaugccagcaaccacuuggcag

SEQ ID NO: 4202803 - RNA, 123 nt, Human
uugcaaaucuuucuuauguuaaaugugacucuaaaaugcuaugagaucugaaaaauaaaugcaaaaucagaaagauuucuucuuaagccuuuugggcaauugacuuuagcaucaaagaggcag

SEQ ID NO: 4202804 - RNA, 81 nt, Human
uugcaaauugguuauucuguccuuuuuccaguuggauagcuuuaaaagggaaagcagaaugacuuuccucaggauuuguag

SEQ ID NO: 4202805 - RNA, 84 nt, Human
uugcaacucauuuccccuguauucuuuagauguaaucauuauccugcauucuguauuuggauauaaggggaagacucuaugcaa

SEQ ID NO: 4202806 - RNA, 70 nt, Human
uugcaagauauugauuuccagcugaugcuuuaacugagcccucagcaaaggcaauucauuauucuuuuaa

SEQ ID NO: 4202807 - RNA, 61 nt, Human
uugcaaguuuauggccucccuuuacugaauagccaguggguggagccaguugacucuguga

SEQ ID NO: 4202808 - RNA, 113 nt, Human
uugcaauucuacuguacccuucauuauucaccuacuuuugccauguguguaaggguauaauuuugcauguacguacagagagagugaguguuaaagggauagagggacaguga

SEQ ID NO: 4202809 - RNA, 57 nt, Human
uugcaccuucauauggacuuugguuuucucaguugacugcagucuguugaagggcag

SEQ ID NO: 4202810 - RNA, 82 nt, Human
uugcaccuuggaaaggucagccaauaguccuuguggggacagacaccuacucugaauaugaguuugccuuuccugccugcag

SEQ ID NO: 4202811 - RNA, 71 nt, Human
uugcacucaggguaauucacagauuugucagugacuucauugcagcugugagcuuuacacgaaccuugcaa

SEQ ID NO: 4202812 - RNA, 102 nt, Human
uugcacucuguuacugcuggaagucaugguuagugauauuaauuuauucagugggcugaguucugugacaauaucauuaccagggaguaauuaaggguggga

SEQ ID NO: 4202813 - RNA, 59 nt, Human
uugcacuuuacaggguaacauagaucuuaugauacuagguuacaguuguuaaguugcaa

SEQ ID NO: 4202814 - RNA, 65 nt, Human
uugcacuuugcucaagccauuuguucaggacaagaaguuccugcaccagaaauagcgaaguguaa

SEQ ID NO: 4202815 - RNA, 62 nt, Human
uugcagaaucucaggaaggagaaaguuccaaggagggaacgguuuggugucugaggcugcag

SEQ ID NO: 4202816 - RNA, 76 nt, Human
uugcagauagucucaguagguaggaaccagaaugcccucaguuugaguucuggcccugcugcugugagcacuguga

SEQ ID NO: 4202817 - RNA, 73 nt, Human
uugcagccaaaagcuugauuuccuuuauucauugaaauccucagaagaaagggaauuaacuugaguuuugcaa

SEQ ID NO: 4202818 - RNA, 55 nt, Human
uugcagcccugugcacauccccucucgggagggccagaguacaucagggcugggg

SEQ ID NO: 4202819 - RNA, 65 nt, Human
uugcagcucugauccagggaccaugggaaccacaugagaggcauaugaaccuggguacauugcag

SEQ ID NO: 4202820 - RNA, 62 nt, Human
uugcagcuguuacugauagauacacuuaucucucacugguguauuuaaucagcaacagucaa

SEQ ID NO: 4202821 - RNA, 56 nt, Human
uugcagcuguugcaaagucucuucaacuuccguugcuuugccuccagcagccgcag

SEQ ID NO: 4202822 - RNA, 55 nt, Human
uugcagcuucuugcaucagaaaaucagauagagccucucuggcaagaagcugcag

SEQ ID NO: 4202823 - RNA, 59 nt, Human
uugcaggcuuuagccccauggcugcucucaugggcugggcugguguugagugccuguag

SEQ ID NO: 4202824 - RNA, 57 nt, Human
uugcaggguacauucuuagaauaggauugcugguucaaagaaaaugugcuuuuguaa

SEQ ID NO: 4202825 - RNA, 68 nt, Human
uugcagugaagugugcacaucuuacaaguauagcucagugaagcuucguauauguguacaccauguaa

SEQ ID NO: 4202826 - RNA, 78 nt, Human
uugcagugggaagcugaggggaugcugggcuccucuguagcaaaggugggugcagcagagcuccucuguccccugugg

SEQ ID NO: 4202827 - RNA, 67 nt, Human
uugcaguguuuaacauccuuagaccaggucaucccagaguugagaggauggauuagacaaaagguaa

SEQ ID NO: 4202828 - RNA, 63 nt, Human
uugcaguuuucuggaggggguugcagucaaggacuugcccugccccuccugcuagauaugcaa

SEQ ID NO: 4202829 - RNA, 108 nt, Human
uugcauauuucgaugggguugagaugaaguuuucugcuucuauuguguuuguucucaggacugaauacaaagcagaacucauacugaaggcucuguaggugugugugg

SEQ ID NO: 4202830 - RNA, 76 nt, Human
uugcaucuuagauuaaccauuucuugcuuuagaaucuacuacagagucaaauaagagagagauguugaugaugcaa

SEQ ID NO: 4202831 - RNA, 129 nt, Human
uugcaugaaacucuugagugcaugccuucaugauggggaauguuaagggagggcaauuuauauaacaugugcucuuugaccaaauuauccuguuaaauaggcuugaaaagcgcuuagaaccacugauug

SEQ ID NO: 4202832 - RNA, 79 nt, Human
uugcaugcggauacaauagacaaagugaauggcuccuaaaugaaggacauacgcauuuuaucauugauuguugcugcag

SEQ ID NO: 4202833 - RNA, 56 nt, Human
uugcauguccuacaucugugucugaaacacaguaugcaaucauggaggaugugcaa

SEQ ID NO: 4202834 - RNA, 62 nt, Human
uugcauuuguucagugaaauguuccuuagcacuaaaaaggaauaaaguauugauacaugcaa

SEQ ID NO: 4202835 - RNA, 84 nt, Human
uugccacuagauuucucacaguggaaucucugccucugguaagagguaaaguucuggugagagguaagaggaaaguucugguaa

SEQ ID NO: 4202836 - RNA, 64 nt, Human
uugccagcucuugauggguggguagucacuccuuucagugguugcccccugggggagaagguag

SEQ ID NO: 4202837 - RNA, 60 nt, Human
uugccaggcugaacagggucuuacuacaaggugguaguaagacauuccaugccauggcaa

SEQ ID NO: 4202838 - RNA, 60 nt, Human
uugccagggccagugggggugucagaacuucucaggcaaacuugcuccugcccuuggcaa

SEQ ID NO: 4202839 - RNA, 110 nt, Human
uugccaucaaagcaaaugacagaggcagucaagagcuggggcucuggguuuaagcagauguggguuugaauccugguuccagcauucuucaaccauuugacuuugggcaa

SEQ ID NO: 4202840 - RNA, 130 nt, Human
uugccauuuacuggcucuuucacuugacuuaguugaguuccucaaaaaggagagccccagaaaaugccuugggugcagguugcuuauuugagggugacugcaggaaaugagagugaggguauaaggacag

SEQ ID NO: 4202841 - RNA, 71 nt, Human
uugccccguacuuaucuguagaaugauacuuuagcauugaagucaauuacagcaaugacuguacguggcaa

SEQ ID NO: 4202842 - RNA, 100 nt, Human
uugcccuguacagccagaauggggagaauauugccuuuaagucagggucaucagcaucauggcuuuuuagcauauucaauaaucauucucuguggggcaa

SEQ ID NO: 4202843 - RNA, 84 nt, Human
uugcccuuaugccuaagaaucaguagauauagauuucuaaagugauaaggaggucucuauaaaaaugaucacauaaagaggcag

SEQ ID NO: 4202844 - RNA, 70 nt, Human
uugccguuugggagugaagauucauuuaccaagagagauucuuuuacuaguuuucauuaccaugcugcaa

SEQ ID NO: 4202845 - RNA, 64 nt, Human
uugccuaguucuuuagcuuccguuggacccucuagggggcuagcauggaauaggaaagaggcag

SEQ ID NO: 4202846 - RNA, 62 nt, Human
uugccucaucaaagauguaaaagguguguggguauuuacucgaaaucagcaucuugaggcaa

SEQ ID NO: 4202847 - RNA, 76 nt, Human
uugccuccgccaucugucuuccaaaugauccuguagguacagcuauuauuucagucagacacuggcaggugggcaa

SEQ ID NO: 4202848 - RNA, 73 nt, Human
uugccucucuggaguucucaugaggaacucuguuuuaugccaagagaccuaagcauguacuccaggguuguaa

SEQ ID NO: 4202849 - RNA, 97 nt, Human
uugccucugcuuugccaggggccucugccugcacaucauccugagaccaggaaagagcugccaggcaggcugucccauuguggggggggggagggga

SEQ ID NO: 4202850 - RNA, 63 nt, Human
uugccucuguuccuugugaccaaccuguguauuacccacaugguaauagggagcagaagguag

SEQ ID NO: 4202851 - RNA, 73 nt, Human
uugccugagcugaacuaagcaguuuuauuugcauacauuuagaagaccaaacugcagccuugaguucagguag

SEQ ID NO: 4202852 - RNA, 69 nt, Human
uugccugccagcagaggccagcgcugcaggggcuccuuggccugccuucgcugagcugauuuuaggcag

SEQ ID NO: 4202853 - RNA, 79 nt, Human
uugccugccugugggcugaaagugcucccgauuuuagcauuuguuuugagccacaucugcccacucguccugcaggcaa

SEQ ID NO: 4202854 - RNA, 61 nt, Human
uugccugcgugcacuggguguauuucccguuguuuugauuauacagucagggcacaggcag

SEQ ID NO: 4202855 - RNA, 55 nt, Human
uugccugcuguuuuccuuguauuuguagcaccuacagcaaggacaacauaggugg

SEQ ID NO: 4202856 - RNA, 127 nt, Human
uugccuugauucagaaagauaagagggucagagcuuuacugagugaccuagaauaaguuguuacauuucuccaagcuuauuuacuaauuuagaaaaugacccucugcccuccguucccuacaggcaa

SEQ ID NO: 4202857 - RNA, 57 nt, Human
uugccuugggcuugacaagcugucaaggauucuugccaaggcugccaagcucagcaa

SEQ ID NO: 4202858 - RNA, 92 nt, Human
uugccuuuccugacacagaauuagugaucaaaaucaaaauugugaaccucaccaauuguaguuuuugaugcuauacaucugaguggaagcaa

SEQ ID NO: 4202859 - RNA, 80 nt, Human
uugccuuuggaauaaucagauccuaguccuuuguggaugcaaguccuuuguggacuaggaucuggucauucuaaaggcaa

SEQ ID NO: 4202860 - RNA, 70 nt, Human
uuuuagccugggcuaggcugagggcauuuccauuaccugaaauggaaauccgucauuggccugguuggag

SEQ ID NO: 4202861 - RNA, 75 nt, Human
uuuuagucaugugagguuucuuaucaagaaagcugcaucuguaagagcugauaaggaauuuuucuuuggcuaaaa

SEQ ID NO: 4202862 - RNA, 65 nt, Human
uuuuauacuucuuuggccacaacuuaaucauaugguugcacauagguacaaaggaggauguaaaa

SEQ ID NO: 4202863 - RNA, 82 nt, Human
uuuuauagguggcagucaacucuuuugugcuccuguaucugggacaguuacagagaugccgaagagugaaauaacuguagag

SEQ ID NO: 4202864 - RNA, 57 nt, Human
uuuuauccucauggcugcaagaugacugcuaauauccaggcugcuaugaggaugaaa

SEQ ID NO: 4202865 - RNA, 62 nt, Human
uuuuaugacaggaaaaucacagaauugauguuggauccuuuucaguguaucuugucagggag

SEQ ID NO: 4202866 - RNA, 67 nt, Human
uuuuaugcuaaccucaucuucuccuucuuucucacuuggagagggagaagacaagauuaguauaaaa

SEQ ID NO: 4202867 - RNA, 58 nt, Human
uuuuaugcuacccaacccgucaguggaaacucuugaagaaauggugggguaguuagaa

SEQ ID NO: 4202868 - RNA, 121 nt, Human
uuuuauucauuuuauuuuugcaaucuagaagugguaccagagagaacaacaaaucugcaacuguacucuugcagaaaacaguuuucuugugccuuagugugcuaaaaugaaaaguguaaaa

SEQ ID NO: 4202869 - RNA, 78 nt, Human
uuuuauuucauuuuuuagccaagacucugcacacaauaggugaucaauaaaugcugagugauugaaaggugaaugaaa

SEQ ID NO: 4202870 - RNA, 68 nt, Human
uuuuauuuuacuugggagacuuuuaagcucugagcauaaauuuuccuggucuuccaaauaaggagaaa

SEQ ID NO: 4202871 - RNA, 71 nt, Human
uuuucaaaauggguuucagaaaugguuuaugcaaugcuaacauugguaaaagaauucugaacuuuugagag

SEQ ID NO: 4202872 - RNA, 57 nt, Human
uuuucaagcugugguaacugagagaagacaucucuuuuaaccuaacuagcuuggaaa

SEQ ID NO: 4202873 - RNA, 77 nt, Human
uuuucaauccuuauuugucuaguuccagugcccaugaccuggcucucuggaauggaaacaaacugaggaagagaaaa

SEQ ID NO: 4202874 - RNA, 123 nt, Human
uuuucacaaugaagccaugaaacaucaaauccuggacuacugauacugccagugaagcauauuucagaugguauauacaguagccaccuccaguuuuuugucucagucuucauacccggaaaa

SEQ ID NO: 4202875 - RNA, 79 nt, Human
uuuucacauguauuuggacuauuguagaauauagaaaagaauaucaugcaaacucuaguccuuuaaauaugagugagga

SEQ ID NO: 4202876 - RNA, 64 nt, Human
uuuucacauucucugguuaucgauucauuauauaacauaauauuugggaucugagaagugaaaa

SEQ ID NO: 4202877 - RNA, 58 nt, Human
uuuucaccagguugcugcacuggggccugucuuuuaguaaagcaauuguuggcgagag

SEQ ID NO: 4202878 - RNA, 83 nt, Human
uuuucagaaagcaaauaaaugauucagcaggaaauagguggcauuuauuucuuaugccuagcucuaucauuuggugcugaaaa

SEQ ID NO: 4202879 - RNA, 120 nt, Human
uuuucagagaauauuauggguuuacaaagaaaauuaggcauuuuuuuaucuaauaauguaaauauuaagaagaugguccaucuauuuucuauaaauguauuaauguuccaacacugaaaa

SEQ ID NO: 4202880 - RNA, 57 nt, Human
uuuucagcaaacacugaguucuugucuuguaccaggcucugugcuaauugcugaaaa

SEQ ID NO: 4202881 - RNA, 57 nt, Human
uuuucagcaauuagcacagagccugguacaagacaagaacucaguguuugcugaaaa

SEQ ID NO: 4202882 - RNA, 77 nt, Human
uuuucagcaggacuucccagggaacaucugacauuagcagagaggaaaugcugauuggccugggagucagcugaagg

SEQ ID NO: 4202883 - RNA, 93 nt, Human
uugggucaguugacagggaaaaggguccugguucucaagagcaaggagagagauuugccugggagugaccaagacucuaggucaaggaaacag

SEQ ID NO: 4202884 - RNA, 95 nt, Human
uugggucggccucuuuggcucucaccgauggcucuggagacggccagggucccguugacucuccagcaguccaugugagacacaaagccacccaa

SEQ ID NO: 4202885 - RNA, 63 nt, Human
uugggucuguagggcuguccaaugauaguuaggcuuaaacauuaaacaaccuuacagaacuaa

SEQ ID NO: 4202886 - RNA, 59 nt, Human
uugggucuugcucacuccacacucccaucagguugcugggcuucugagaaagcaccuaa

SEQ ID NO: 4202887 - RNA, 87 nt, Human
uugggugaugccugcugggaccacacuuugaacaacaaguaguucucugcuuguggucuggagaccagcagcuucaguguuaccugg

SEQ ID NO: 4202888 - RNA, 63 nt, Human
uugggugaugugggggagcuaaagauccugagggaugacuuugcugcuguauauggagcccag

SEQ ID NO: 4202889 - RNA, 107 nt, Human
uuggguugguuccaagucuuugcuauugugaauagugccgcaauaaacauaugugugcaugugucuuuauagcagcaugauuuauaguccuuuggguauauacccag

SEQ ID NO: 4202890 - RNA, 64 nt, Human
uuggguuuucccuugaaacugaauagucacaacuucauaaaauguuuuaagggagaaaaccuag

SEQ ID NO: 4202891 - RNA, 77 nt, Human
uugguaauuucaguauuagguacugauacuaaggaaguaagcauuugcuuagauucagcacuuuuucugagaaccaa

SEQ ID NO: 4202892 - RNA, 62 nt, Human
uugguacagaugagguauucucccaagaagggcaagagcaaaccuuaucucuucugugcuga

SEQ ID NO: 4202893 - RNA, 55 nt, Human
uugguagaucucagcucaggauucacgcauaccauguaguccuggagaucaccaa

SEQ ID NO: 4202894 - RNA, 84 nt, Human
uugguagcauugaugugaguuuacauuuggggcucccaagccaaacugucagaaaagaccacauuauucuuuguaauuugccaa

SEQ ID NO: 4202895 - RNA, 57 nt, Human
uugguccaggauggcgugggugucaaggaugacuuccaggcaugagcucuggaugga

SEQ ID NO: 4202896 - RNA, 55 nt, Human
uugguccucaguuucccuaucugugagaggacacuuuggggaugcugaugaccaa

SEQ ID NO: 4202897 - RNA, 84 nt, Human
uuggucuacagcuuugccaaguaaggucuuugaaagguagcuauagacuuuugaaugccuucauuggcgaagugcuuagaccaa

SEQ ID NO: 4202898 - RNA, 56 nt, Human
uuggucugcucugauguuuucuaucugacagagagaaggcugagcagacaggccaa

SEQ ID NO: 4202899 - RNA, 70 nt, Human
uuggucuuauuuaaccuaaauuucuagaucauagauaguguuaauggagaaauagguaagaggaggguag

SEQ ID NO: 4202900 - RNA, 68 nt, Human
uuggugagccucuuagcagcagucuacucuucccagugugauuuaccugucacugaugggcucaccag

SEQ ID NO: 4202901 - RNA, 80 nt, Human
uuggugcaaaaguaauuguggcuuuugcuguaauuauuuucugcaaguaauggcaagaaccacaauuacuuuugcagcaa

SEQ ID NO: 4202902 - RNA, 57 nt, Human
uuggugccaucuuccuuccucugcaccuggaaaggauagggaaggaagaggcuuuga

SEQ ID NO: 4202903 - RNA, 55 nt, Human
uuggugcugauaauggcaggauuuggagccucaguccccauuuugucagcaagaa

SEQ ID NO: 4202904 - RNA, 101 nt, Human
uuggugcuugagccagaugaggcagccuauggggagcucagggccauggugcuggaccugagggccuucuaugcugagcuuuaucauaucaucagcagcaa

SEQ ID NO: 4202905 - RNA, 71 nt, Human
uuggugggggcucggacccaacagcauauuauucuuggaaaagacuugcucuggguccugggccuccucaa

SEQ ID NO: 4202906 - RNA, 65 nt, Human
uuggugguguaggauggcuugguuguaaccaagggaaagaaccaaguuauucugacacucaucaa

SEQ ID NO: 4202907 - RNA, 84 nt, Human
uugguguaagacuccuugaaccauaaaaugaauguuaaagucccaugcaguuuguaucuaugaguacaaggaaucuuccaguaa

SEQ ID NO: 4202908 - RNA, 76 nt, Human
uuggugucucaaagugcugggauuacaggcaugagccaccacacucagccugguuuaagcauuuuauaugacucaa

SEQ ID NO: 4202909 - RNA, 61 nt, Human
uugguguggaggguggccaauucugaugaugaugcggauaauggccaccacuguauaucaa

SEQ ID NO: 4202910 - RNA, 68 nt, Human
uugguguugaagugcugaguauugaugcagaagggauuuugcagcaugcauagacacugcaauagcaa

SEQ ID NO: 4202911 - RNA, 56 nt, Human
uugguguuucuggaaagucuguaaggcagcuaaugcagagcuccccaagacaccaa

SEQ ID NO: 4202912 - RNA, 68 nt, Human
uugguuauguccaggugugagaugaucacugcuucuaaagcuagaaagugccacaacuggacaaccaa

SEQ ID NO: 4202913 - RNA, 70 nt, Human
uugguucccugggguguacaccucacugugcaaacuacugguacaaugagcuguacaucuccaaagccag

SEQ ID NO: 4202914 - RNA, 77 nt, Human
uugguucuuuggaaggaacaggauucucuccugggaaaagagacacagugaggaucugcagccaucuucaggaccaa

SEQ ID NO: 4202915 - RNA, 65 nt, Human
uugguucuuuguggcucagaucugucaccccuuaaugaaguggcuuucuggcugccaaggauuga

SEQ ID NO: 4202916 - RNA, 68 nt, Human
uugguugaauuuagauuagagcagagacgucauuugaucuuagugauguacuugccuuaucuauccaa

SEQ ID NO: 4202917 - RNA, 67 nt, Human
uugguugcuagauugugugcauguguaagauaaauugguuuuacaacagacacauauucuaaaccaa

SEQ ID NO: 4202918 - RNA, 97 nt, Human
uugguuucugguaggguuuuccuuuagugguauuuuagcaaguaauacaauccaguuauuuuuaaaaguauauuaguagaaacucaccagaagucaa

SEQ ID NO: 4202919 - RNA, 82 nt, Human
uugguuugagcuucccucugcgcauugaauuucaggccuacaugacuggaacccaaaugaggagggaaucuugagaaaccaa

SEQ ID NO: 4202920 - RNA, 55 nt, Human
uugguuuucaggggcaggauaaaugcuacaacagccuucagcuuuugaaaaccaa

SEQ ID NO: 4202921 - RNA, 86 nt, Human
uugguuuuuaaaguauuacccucagaacuugaugaagauuuuaauucuugucccucuucacuaacucugugggugaugucuaccaa

SEQ ID NO: 4202922 - RNA, 58 nt, Human
uuguaagaauagucccuagaugugugcaaaacacacucugccuaacuauucuugacag

SEQ ID NO: 4202923 - RNA, 69 nt, Human
uuguaagauucagggaacaugaaagcuaucauacucacauugacuggcugcguuccugugagacugcag

SEQ ID NO: 4202924 - RNA, 79 nt, Human
uuguaagccacugagauuucacugcagcucuuucuaaguaauaagagugaauguaaggaggaaaauuaguggucuagga

SEQ ID NO: 4202925 - RNA, 75 nt, Human
uuguaaggcagagcuaggaagaauuguggcaaccuccuaacaacucuuucuagucucuauucuugcugccuucaa

SEQ ID NO: 4202926 - RNA, 76 nt, Human
uuguaaguauugcaucucuucauaucuguuaugcaccaagcauagcacuaagugcuggagauacaauuguguacaa

SEQ ID NO: 4202927 - RNA, 84 nt, Human
uuguaauuggaaaaaugucaauuuuugauucuauaacugaaaacaaguguuauuuggguuugaguguggcagccuucugugcaa

SEQ ID NO: 4202928 - RNA, 73 nt, Human
uuguaauuucccuuuggguccuggcuggccuagaugcacauucaagugggugggcgacugagagggguuucaa

SEQ ID NO: 4202929 - RNA, 82 nt, Human
uuguacaaaccgucuuuacacaagacaagaauaacauaggaaagaacuauuugucucugaucugugcaaagaaggagagcaa

SEQ ID NO: 4202930 - RNA, 63 nt, Human
uuguacaguuuaagugggugaauuauaugauaugugaaugauagcucacuaaaacuguuacag

SEQ ID NO: 4202931 - RNA, 75 nt, Human
uuguacuacaauguucacaacauuguuaauaauagcuaaaaaugaaaacaguguaagugaucauugauaguagga

SEQ ID NO: 4202932 - RNA, 67 nt, Human
uuguacucaggagacuuaugucacagugauggaaacaaugcugcuacagaaagcuucaaaggugcaa

SEQ ID NO: 4202933 - RNA, 61 nt, Human
uuguagccuuucugucucacuuucugucauuuugugggauuuggggcggaagggaagauaa

SEQ ID NO: 4202934 - RNA, 97 nt, Human
uuguaggauccugcuaguuuaauaacugaguuguuaauuuucuauagaagccauuuaaaauaggaaauggcucaguuacugcaccggauugcuacaa

SEQ ID NO: 4202935 - RNA, 62 nt, Human
uuguauacaggauuacucauagcaacucuuaggagguagagcuaaugugauucugcauacag

SEQ ID NO: 4202936 - RNA, 86 nt, Human
uuguaucagugcugcuuuagcagugcccuguggaauaagacaccuccugcucaauguucccuguacugcuuuuaaggugugaacag

SEQ ID NO: 4202937 - RNA, 100 nt, Human
uuguaucccucuugccucaacucuggaauugguuaccacuacuucugaacuggguggcagcuacagacagaggugaguaugcagaaaagaggaauugcaa

SEQ ID NO: 4202938 - RNA, 60 nt, Human
uuguaugaguaugguguauaggcacuguaugugguguguguaugcaguauguguguauaa

SEQ ID NO: 4202939 - RNA, 90 nt, Human
uuguaugguuaagacugccagcuucuuacggcugccuuguugagaggaagagaggcaggcuggaagcugggaggcaagacauucaugcga

SEQ ID NO: 4202940 - RNA, 93 nt, Human
uuguauguaaagguagcuaaacauaaucuauaugaaaauacaggccacauauuuucuguaauauaauuaauuuagcugccucuguagguacaa

SEQ ID NO: 4202941 - RNA, 57 nt, Human
uuguaugugccagaugcucucucuguugagacaaggaagaguaacuggcacauaggg

SEQ ID NO: 4202942 - RNA, 67 nt, Human
uuguauuagauuuaagacccugaauuugggggcucaagccucauuaaauuucuugauucuuauguga

SEQ ID NO: 4202943 - RNA, 85 nt, Human
uuguauuggguuucugucauuuucauccuaaggagcaccuaugaauucagggcccuuguccuguaaguugacugauacaaugcag

SEQ ID NO: 4202944 - RNA, 58 nt, Human
uuguauuucuccacuuucuguuuaggacuacuaaaugcugaaauauggacgaguacag

SEQ ID NO: 4202945 - RNA, 91 nt, Human
uugucaagagucucaacagugccagcuaccucuaugaggucauggagcggccccgccaugggagguuggcuuggcaugggacacaggacaa

SEQ ID NO: 4202946 - RNA, 79 nt, Human
uugucagaaggaaggcuuccugaugccaaccacuuugaaauguaacaugguuuauaagagccaggagccccuucuacaa

SEQ ID NO: 4202947 - RNA, 59 nt, Human
uugucagcugcagugggggaccacaacuccuugaguucugcccagcugcagcuggacaa

SEQ ID NO: 4202948 - RNA, 66 nt, Human
uugucagucuguggcauuaauaaaagugcaaucaucuugcuuuauuuuaaauaugccaugugagaa

SEQ ID NO: 4202949 - RNA, 64 nt, Human
uugucaucauccucuuugggguaggaaugccacgucagccuuuccucauagaaggauaugacaa

SEQ ID NO: 4202950 - RNA, 86 nt, Human
uugucauuuauggccugaaaaacacacuggaccaauuuaacuaaaaauuguaaauuguggccauuuguguuucuaugaguaugcaa

SEQ ID NO: 4202951 - RNA, 86 nt, Human
uuguccccugccaucuggaugccauugauaugucucagcucagucaugagccuggugauaucagugguuuccaugucaauggauga

SEQ ID NO: 4202952 - RNA, 69 nt, Human
uugucccgugucuuaacagauuguuuaaagaccuacaucgugaaaacagucuugugggcuuggagauaa

SEQ ID NO: 4202953 - RNA, 59 nt, Human
uuguccggugagggggcugcagagugagaugugaccauucugggcuaccuucccggcag

SEQ ID NO: 4202954 - RNA, 101 nt, Human
uuugggaauggggaagcagucucauugaggaaagguaguggcuucucuagucaguucuccauaugaagucauuugucucagugauuucuccauuacccaga

SEQ ID NO: 4202955 - RNA, 72 nt, Human
uuugggagacuuugacgaaagagucauuaaguucauuugcuucauuuguuuuccaagucaaagaaucccaaa

SEQ ID NO: 4202956 - RNA, 61 nt, Human
uuugggaggaaggauuuuugccuucucagucuacugauucaaaugcuaacuucuuuccaaa

SEQ ID NO: 4202957 - RNA, 69 nt, Human
uuugggauccauggagaaggaggugucugugggaucuccaggcucuaucccuccuucuucacucccaga

SEQ ID NO: 4202958 - RNA, 66 nt, Human
uuugggcuagauaacuuauuuucaaggauguuucucaacuuucuuuugaaguuauuuggugcugaa

SEQ ID NO: 4202959 - RNA, 100 nt, Human
uuugggcugcauaggcaggugcauaaggagccucaggaaugcugcuggauucagacucuggucccugugucaccucucacccucauguauaaggcccagg

SEQ ID NO: 4202960 - RNA, 92 nt, Human
uuuggggagggcagcugaaaucacuaacgccagccuggcucuaaccagccugugcaguuuuaaguggucuaaucagcccugcuuuucacaaa

SEQ ID NO: 4202961 - RNA, 79 nt, Human
uuuggggaucugaaguuguggaucuuguugucaugaauuaguuccuauuagugacaaauucauauuucagaggacuaaa

SEQ ID NO: 4202962 - RNA, 72 nt, Human
uuugggggccguuccugggagcugcugguaccaguauacauaauuacuuccgauguuggagcugcuuccaga

SEQ ID NO: 4202963 - RNA, 87 nt, Human
uuuggggguuuuggucugggaggguucacaguuaguuucucauggaaacagaccaguagggcucaucccagugcuggggccgucaga

SEQ ID NO: 4202964 - RNA, 69 nt, Human
uuugggguugcuugucuuuuugagucauagaacuucuuuauguauucugaguacaaguucuuuuccaga

SEQ ID NO: 4202965 - RNA, 93 nt, Human
uuuggguauuuugcaggagugggguugagugauuuauuuuaaaaaagugaguaagaauagaaucauuggaaccacauccaagaaguuuccaga

SEQ ID NO: 4202966 - RNA, 65 nt, Human
uuuggguucugucccagcauagggcacaaaugaugacucaggguaguccagcugguaugcccaga

SEQ ID NO: 4202967 - RNA, 82 nt, Human
uuugguaaaagacagugauaccuugggauguggcagcucuacaaaucuacauugcuaacaccagucaacuguucuuaugaaa

SEQ ID NO: 4202968 - RNA, 71 nt, Human
uuugguaaauguguaugaggaagagagaaacaauuagaaguucucugucacacaaucuacacacuaccagg

SEQ ID NO: 4202969 - RNA, 121 nt, Human
uuugguaccagcucccauaaacccaauugagaaauauaaucuggaaaguuguaaauauaauucuguuucuucuguauuuuuuguuguuguuguagggagcaugguguuccuccuaaccaaa

SEQ ID NO: 4202970 - RNA, 59 nt, Human
uuuggucuugaguggcuuguuaagugguagugacauuucaugaguuggacaagacuggg

SEQ ID NO: 4202971 - RNA, 92 nt, Human
uuugguuguguuuucuuauuguugcuaaaaguccugugauuaaccauauccuguuucuuacaguaaggguaaauaagaacaugcuaaccaaa

SEQ ID NO: 4202972 - RNA, 57 nt, Human
uuugguuuagggucauuuaacacugaaucagcagucuuuccgggauaauaagccaag

SEQ ID NO: 4202973 - RNA, 92 nt, Human
uuuguaaacuuauaauuuuuagguugggcuuacuauuuugaugagaagggugaaucugucaaaggguaagcuggauaacuguauguugcaaa

SEQ ID NO: 4202974 - RNA, 59 nt, Human
uuuguaaccuaaagcaccagauuuccuuucugcauuaccagugugcguuuaggugcaaa

SEQ ID NO: 4202975 - RNA, 59 nt, Human
uuuguaagaacuauaaauugcuuggguucacucucuuccuuguauguaguacuuauaaa

SEQ ID NO: 4202976 - RNA, 74 nt, Human
uuuguaaugcaucuguugaggucugacaaagccagaaaaaaacuguguugucuacuucaauuuguauaugugaa

SEQ ID NO: 4202977 - RNA, 63 nt, Human
uuuguaaugggauaucugaaggauuugccaagcugcaaacagucaggagagcccaucuacaaa

SEQ ID NO: 4202978 - RNA, 129 nt, Human
uuuguaaugucccaccaaacaaguuauaaaauacauauuuaugaauuugucucaggcugaagucucacuagcuguuagagaggauuuuaaaagcauauguguauuguaucguggcuaaacguggguaaa

SEQ ID NO: 4202979 - RNA, 61 nt, Human
uuuguacagaaacugcauuuggagguuggaggaaccuccaacugcuggagucuuugucgag

SEQ ID NO: 4202980 - RNA, 57 nt, Human
uuuguagaggguaauugacagacuuuaagggcccugguucuguugcccuuucacaga

SEQ ID NO: 4202981 - RNA, 86 nt, Human
uuuguagcucccugaugauagugauuuauugaggggaaucaguuuucuacuuaaaggaccauuagucgucucagaaagcuuacaaa

SEQ ID NO: 4202982 - RNA, 60 nt, Human
uuuguaguguugcuaguauaaaaaaagauacaaguucaaaauaugcuggcaacauacaaa

SEQ ID NO: 4202983 - RNA, 67 nt, Human
uuugucaccugggaccauuuagcccacucagcuguggggagcgggugcaggggacccuagggacgga

SEQ ID NO: 4202984 - RNA, 79 nt, Human
uuugucauuaccauugcuugauagcugaaaauuggaaacagugccaguuaauaagaaauggguauauccauaugauaga

SEQ ID NO: 4202985 - RNA, 64 nt, Human
uuuguccuauaauccucuuacauaagagggcaaaguacucguugugauacauuuauggggcaga

SEQ ID NO: 4202986 - RNA, 69 nt, Human
uuuguccucuccauguacaauagcuguggcucaacccacugugaucaauguuuauggaaaagagacaaa

SEQ ID NO: 4202987 - RNA, 82 nt, Human
uuuguccuuuguuacucugggguuguggugaaggagauaacaaacucucuugucacuaguggaaucugggagcaaaggcaaa

SEQ ID NO: 4202988 - RNA, 84 nt, Human
uuuguccuuuuaaaaaaggagcuguuuugccauuugaacagggguuucugcucaaaggaaacacaagcuucuggagagaacaga

SEQ ID NO: 4202989 - RNA, 68 nt, Human
uuugucuaacgucacacagccaggaugaaaaacacagguauucuggcuguguaauauguguagggaga

SEQ ID NO: 4202990 - RNA, 68 nt, Human
uuugucugugcauccuuaacgccugccuaguaugaaugcauggagaggugaauggauggauggaagaa

SEQ ID NO: 4202991 - RNA, 80 nt, Human
uuugucuuaaguugcagaauacauuugggauuacuuugaucacaucacagagaugccauuuguaugcacuuuuaaacagg

SEQ ID NO: 4202992 - RNA, 58 nt, Human
uuugucuuaggucuuuuucucuccuaccccguggaaagaaaugcaguuucaagacaaa

SEQ ID NO: 4202993 - RNA, 58 nt, Human
uuugucuucccccuuuaaucagucauaaguccugucauuauccagugggggagagaga

SEQ ID NO: 4202994 - RNA, 71 nt, Human
uuugucuucucuagaugucuugugcuuuacuacaugcugacuugcauguggaagauacuccagaaauuaaa

SEQ ID NO: 4202995 - RNA, 130 nt, Human
uuugucuuuaaaauucacaggucuccaagagaaguugaaucaagaucuggcauugaucaugagauccuggacauaaugucaaugcaaucauuggacaagucuuuugggauaucuuggggaagaggaugag

SEQ ID NO: 4202996 - RNA, 60 nt, Human
uuugugaacaaacaugaagaugggcacugccccauccaccuuuaugucucgguccacaaa

SEQ ID NO: 4202997 - RNA, 90 nt, Human
uuugugaauacauuuacauguaauguuauacaaagguaugaagacaaaaugccguuugguuguaucauucuaugaauugcuuucaucgaa

SEQ ID NO: 4202998 - RNA, 79 nt, Human
uuugugaauuucagagaugacuuauuggcugcucagaaggaaauucugucucagcaggaagucaucaugaaguuaagga

SEQ ID NO: 4202999 - RNA, 65 nt, Human
uuugugcagauguauauuuguguagaaucuuuauuugugguaaucacagguaacauaugcacaaa

SEQ ID NO: 4203000 - RNA, 83 nt, Human
uuugugccauaugcccaguuauuuccaguguaugcuuuuguagaaugcaaagcugggugugaaugcacaugugguuuuacaaa

SEQ ID NO: 4203001 - RNA, 129 nt, Human
uuugugcucaauaauuauuuacuaauuaguuauuugauagcaguggaucuuuuggccugauuaauccugauauugcuuuaaaccucuacucuguccauguagcuauuagaauguaagaucucccacaaa

SEQ ID NO: 4203002 - RNA, 69 nt, Human
uuuguguauuuauggaaaucacgugagaaguucaggcugucauguguccuaguucauauaauauucaaa

SEQ ID NO: 4203003 - RNA, 63 nt, Human
uuugugucuauuuuuacuggaccaugcugugauauuuaguaugcacuuaaaguggacaucaaa

SEQ ID NO: 4203004 - RNA, 90 nt, Human
uuugugugcugucuguuuacuggcuauagauuugguaauuuacuuuccuuccauauuucuugugguuaguugaauacaacagcauggaag

SEQ ID NO: 4203005 - RNA, 78 nt, Human
uuuguguucagugcauucauggguggcuggauguaugaacagauggaugaaugaaugaagcgcuuauauaaacacaag

SEQ ID NO: 4203006 - RNA, 90 nt, Human
uuuguguucuguaauugcuuuagggcaaauauuucaauguuuaauuuauauuacgaaauugucuuaagaguuugaguauuagaaaacaaa

SEQ ID NO: 4203007 - RNA, 58 nt, Human
uuuguguucuugggggucaucgagguaacaguuauacccuccuuccccccagcacaga

SEQ ID NO: 4203008 - RNA, 86 nt, Human
uuuguuaacagugaacauacuuuugcauuguuccacaaacucuuaagaugguuuugggcaguagauguaucacuuuuagaaacaga

SEQ ID NO: 4203009 - RNA, 61 nt, Human
uuguugucagccuguguuacaaagccuuguguugcaaugugacagaacagguugggagcaa

SEQ ID NO: 4203010 - RNA, 123 nt, Human
uuguuguuaauuaaaccccuauugagcacuaauugcaauuacucuagagaauccucaauauauuuauacuuguguucuacuagagaaaaugugucugaguagcaaaauuauuuaaaauaacag

SEQ ID NO: 4203011 - RNA, 62 nt, Human
uuccuggugguuuaugagaagugagggggaaaagaaauuucuggcucugaugacuagaggaa

SEQ ID NO: 4203012 - RNA, 65 nt, Human
uuccugguuugccuggaauccaggccuuuugauaucugaggcagauguacccaggcaagcaggaa

SEQ ID NO: 4203013 - RNA, 89 nt, Human
uuccuguauuugcuuuguuuugauuugaaaucagucuuugggauuacauuggauaauuuuuucauguuauuaauagugcugugcaggga

SEQ ID NO: 4203014 - RNA, 58 nt, Human
uuccuguccuuuggauugucucaacugugaagagagaaauaucccaaaagacaaggaa

SEQ ID NO: 4203015 - RNA, 60 nt, Human
uuccugugguccagagucauccucaguauucccggugaggacuggcuauuccacaaggaa

SEQ ID NO: 4203016 - RNA, 58 nt, Human
uuccuguguacguguuucgcuggagggaacugucccagaaucaauauuugcauaggaa

SEQ ID NO: 4203017 - RNA, 75 nt, Human
uuccugugugaugggaagaauguuucagcaggaaauaaaaccacagaagaaacacuuuuuuuauccuacagagaa

SEQ ID NO: 4203018 - RNA, 66 nt, Human
uuccugugugcucucauuuaguaggccugcuuuauugacuugguccccacaaaugugucacaggaa

SEQ ID NO: 4203019 - RNA, 57 nt, Human
uuccuguucucacuuucaacuaggggagccaugugauccuggccaaugagauaggaa

SEQ ID NO: 4203020 - RNA, 76 nt, Human
uuccuguuggcuaugaugcccauacacguucuuuuuccagauggaaccaaaagagaaaguggcaggcuuucaggga

SEQ ID NO: 4203021 - RNA, 56 nt, Human
uuccuuagcagaccugguauccuugaauuaagaggaugucaggcacuuaugaggaa

SEQ ID NO: 4203022 - RNA, 58 nt, Human
uuccuuauuccuugauauaaugaguuaucuaauuauggugacaucuguugaggaggaa

SEQ ID NO: 4203023 - RNA, 55 nt, Human
uuccuugagguauucaguuuuaaauguuuacauuuaggcucagauacccagggaa

SEQ ID NO: 4203024 - RNA, 79 nt, Human
uuccuugcaaguucuuaaccgauuuguucugauguugacauaacacagauaaggcaguuaagaguuuaaaaccaaggaa

SEQ ID NO: 4203025 - RNA, 92 nt, Human
uuccuugcuguguauuuguuucagggccuugguaucagaguugcaauuucagucuccgaaccugggucauuguaacaacauccagcagggaa

SEQ ID NO: 4203026 - RNA, 65 nt, Human
uuccuuggccccaugcccagggcucugcuaagggucugaacaugggcauggggcuaaauguggag

SEQ ID NO: 4203027 - RNA, 58 nt, Human
uuccuugggaaaugcucguuuacauuuagugaaugguccugguaguuuugacaaggaa

SEQ ID NO: 4203028 - RNA, 62 nt, Human
uuccuuucauuuuuauaaggcuaauguaacaaggauguugcagaggcaaaaaugaacucgaa

SEQ ID NO: 4203029 - RNA, 59 nt, Human
uuccuuugauuucuugcuggagcucccccuuagccaaacacaagcagaagucagaggga

SEQ ID NO: 4203030 - RNA, 93 nt, Human
uuccuuuuuccuccuguguguugaaaugucagguagagugugaauuagugaugaacugugcugagaggaaagaaugcacagagaaaagagggg

SEQ ID NO: 4203031 - RNA, 95 nt, Human
uuccuuuuuuuccauuaucagucacaguauguccugggcuggguuauguuguaauuuaacuaacucuagcuagaggauuaguggcuaagaaggga

SEQ ID NO: 4203032 - RNA, 113 nt, Human
uucgagguuugugguuauauauuuaaagugcaaucaguuagaccauuuggguaaaggucaacauggaaaaggcugauuucauuauaaaagcaugugagacagagacaagugga

SEQ ID NO: 4203033 - RNA, 77 nt, Human
uucgccacuagggggcagcauugguuuacacagggugaacaaacguucaauucuaaacuaauauucuuuggugggaa

SEQ ID NO: 4203034 - RNA, 99 nt, Human
uucgcgcuucggguugugcaagcuuccuccugccugcuuuggggccuuucugcaauguuccagaagcggcaucaggaggcugcccagccagcucgugag

SEQ ID NO: 4203035 - RNA, 78 nt, Human
uucgcugcuggcccuucucuuccugggagcgcucaucauugcccagcugccagaagaggagggguuagcauuggugga

SEQ ID NO: 4203036 - RNA, 67 nt, Human
uucgcuuuguuaggggcucaggguggauaguuuacuuuuacccucacggaccaccuguacaugugaa

SEQ ID NO: 4203037 - RNA, 107 nt, Human
uucggcuuacaguccucuguugaaguuaccuuucugaaacuucguugcaagcaauauaaugaaguuguaaggagaguggguucuggcauagaaagacuugaguugga

SEQ ID NO: 4203038 - RNA, 73 nt, Human
uucguaaagcagugcaauguguacagaaaaauuucuauaggaaccuuuaugauucacaauguauuuuuaugaa

SEQ ID NO: 4203039 - RNA, 59 nt, Human
uucguguuugaggcagguaagagauguaaaaaacuuuuacaaagcaguuccaacacgaa

SEQ ID NO: 4203040 - RNA, 68 nt, Human
uucguuuauguuccuuccagagagcagaaguguucaauuucugugguaugaaagaaauauggaaagag

SEQ ID NO: 4203041 - RNA, 61 nt, Human
uucuaacagcauuuuuuaaaaaucagggcaugcuuugugcccucaguagaaaauguuagaa

SEQ ID NO: 4203042 - RNA, 70 nt, Human
uucuaagaaagauguugacuccuuugauguaggaugcuucgacucaaauugcuuagcaccuagcuuagaa

SEQ ID NO: 4203043 - RNA, 83 nt, Human
uucuaagcauuguacauauuuguaacucacuuaaccucacaaccuugugaggcagggaguuuaauuguccucauuuugcagaa

SEQ ID NO: 4203044 - RNA, 90 nt, Human
uucuaagccucaguuuccucaccuguaagauggaagagauaguacucauacgcuucuguucaucucaugggagaauggggaggguuagaa

SEQ ID NO: 4203045 - RNA, 101 nt, Human
uucuaaguauaggaacucugcgaccuggaugauaacagcaauauuuuuucuuaaguuuuguuuuguuuuccugggaagaguacgucuauguaaacuuagga

SEQ ID NO: 4203046 - RNA, 89 nt, Human
uucuacaauuagcaucuacuaguaguaucuuugaaacacaaugagauauguuuacucauugauaaaguacugcuuuuguaaagguagga

SEQ ID NO: 4203047 - RNA, 73 nt, Human
uucuacacucaaccugaugaauugaauuuaacaaacaugucaaauauuuuuuaugguuggcccagguguggaa

SEQ ID NO: 4203048 - RNA, 82 nt, Human
uucuacagguaauuugugugguagcuucauugaacagugcuggugcuguucacugaaacuaccacacagaucaccuguagaa

SEQ ID NO: 4203049 - RNA, 55 nt, Human
uucuaccugagcuaggagggaaaaugugccuuuccagcagccaagaaggguagaa

SEQ ID NO: 4203050 - RNA, 65 nt, Human
uucuacucacauuucaucaggccaagaaaaucauguggucaagccugauaucagugugacaggag

SEQ ID NO: 4203051 - RNA, 59 nt, Human
uucuacuuuagcaugcucauucuuuugagaauugaggaauggcuggcccgagguaagaa

SEQ ID NO: 4203052 - RNA, 57 nt, Human
uucuagaacacugaauuuuuggcugccaagaagucagcucagcagauucuucuagaa

SEQ ID NO: 4203053 - RNA, 59 nt, Human
uucuagaagaacuagccaggaaggugggagggugacaugauccaggugguguucuagaa

SEQ ID NO: 4203054 - RNA, 55 nt, Human
uucuagaagcucuaggggagaaucuguuuacuugccuuuuuuuuagcuucuagag

SEQ ID NO: 4203055 - RNA, 65 nt, Human
uucuagaagggccuaggcauaagguaugguuugggaaauugccuuggccaaggaccuuuuuggag

SEQ ID NO: 4203056 - RNA, 84 nt, Human
uucuagcaaauuauugagucugacaguggucuugguaaccucaaacuauaacgagucacacagguuugcaaugauuuguuagag

SEQ ID NO: 4203057 - RNA, 86 nt, Human
uucuagucacuguccacuucauguaguccaucagguuaaugcacuucggaaaugugacuuccuauacugaacuggacugucuagga

SEQ ID NO: 4203058 - RNA, 71 nt, Human
uucuauacaacaguauugugggccagguaaaucaugcuguuuucugcuaucacacugauguugauguagaa

SEQ ID NO: 4203059 - RNA, 78 nt, Human
uucuauccgaaggaaacacugaacuuuguaguguuagcagcagcugaaauuuagaauuauuguuuccuucuaacagaa

SEQ ID NO: 4203060 - RNA, 67 nt, Human
uucuaugaggugaaaaacugugcaugccaucagucaagcuguacagcaaguucaccuugggauagaa

SEQ ID NO: 4203061 - RNA, 88 nt, Human
uucuaugauguggcaguugcuguggcaauaauggggcuggaagcuccauuauugaagcuucaauugucccauuuuuccauguguagaa

SEQ ID NO: 4203062 - RNA, 81 nt, Human
uucuaugcccaguuuauaagaaagaaaaccaaguucaagagcuguagcccaagguuuuaauugucagggcuggaauuagaa

SEQ ID NO: 4203063 - RNA, 65 nt, Human
uucuauggcagugcaggauuuauuuagugauaaugccugguuuuugguccuguacucucauugaa

SEQ ID NO: 4203064 - RNA, 62 nt, Human
uucuauguguucugaauuagguaaauaugacuagaaguccuggagcuucagaauuuguagaa

SEQ ID NO: 4203065 - RNA, 72 nt, Human
uucuauuagauucuacugucacuuaguugguaauuauuucagcccaacaauaagaugauuuagaguugugaa

SEQ ID NO: 4203066 - RNA, 82 nt, Human
uucuauucuucccaccaaaugcacaaggaaauggggaacuugggcuagucucucagaagugcaugugguaaagaggagagaa

SEQ ID NO: 4203067 - RNA, 101 nt, Human
uucuauuguaaggaucaaaugagauaauguaugagcgugaaagcacugugugaucucugaagcacagugaauuacuuuuauuauuauuuuucucaauagga

SEQ ID NO: 4203068 - RNA, 93 nt, Human
uucucaaaauucagagagugaguggacccugcaaggaaggauucaccuuuuuaaacucuuggggucccugcacagaccauuuaauacugagga

SEQ ID NO: 4203069 - RNA, 82 nt, Human
uucucaaaccugcuauaacuggguauuagacuaccuuccaugguguaguguaugauacacucaguuaagcuguaggggagag

SEQ ID NO: 4203070 - RNA, 68 nt, Human
uucucaacaacagugagauauuucagucaaugugcugacugaauagaaaugcucauagguuguaagaa

SEQ ID NO: 4203071 - RNA, 83 nt, Human
uucucacuuuacaguuugggauacugagucuaagagaggcccagugcuucuuuggaugcguuacuuuuacugcuguaggagga

SEQ ID NO: 4203072 - RNA, 80 nt, Human
uucucagacaauagauggaguucauaucaugugccaacccugaucaaaugguaguagcauuccauauacugucuugugaa

SEQ ID NO: 4203073 - RNA, 61 nt, Human
uucucagacuccugagggaaggaugcuacccagcuacagcugguuccucgagaguuuggaa

SEQ ID NO: 4203074 - RNA, 61 nt, Human
uucucagagcucacuguaguaagggaaggacaccugggaaggauuacaggaacucugagga

SEQ ID NO: 4203075 - RNA, 58 nt, Human
uucucagaugauucagauaaacuucaggaucccacacuccuucugaaucaucugggaa

SEQ ID NO: 4203076 - RNA, 74 nt, Human
uucucagccaauacaauuaccaguuaaucacaauagugauugaccucuguugguuggauuauaccaucugagaa

SEQ ID NO: 4203077 - RNA, 86 nt, Human
uucucagcuugagccaaagcacccggcccugggcagcugagcaucagcacagaacccucugaguccuuugggcucucugcugagga

SEQ ID NO: 4203078 - RNA, 64 nt, Human
uucucagcuuuccugcagcuaagggugguagagugacccacuucagauuagagcaacaugagaa

SEQ ID NO: 4203079 - RNA, 82 nt, Human
uucucaggcaguauguccuuccucguuggcagcacuuucugcugaaccugccagugaaaugaagccuaugacuuucugggga

SEQ ID NO: 4203080 - RNA, 57 nt, Human
uucucagggucuugugcaaggggauaccaaagugcccucuuguguagaaccugagaa

SEQ ID NO: 4203081 - RNA, 55 nt, Human
uucucaggguuugugcaggcuugcguauuaguaaaaguuugaaaauucuugagag

SEQ ID NO: 4203082 - RNA, 74 nt, Human
uuuuggcuuuuauuaguggcuagauggggagagggauguaaccugaacccuaaugcagcugagaagggcuaaga

SEQ ID NO: 4203083 - RNA, 77 nt, Human
uuuuggcuuuucuaguuuucucaaaugacuugauugaagacaaucugaguaauucaagacuagagaggcaaacaaga

SEQ ID NO: 4203084 - RNA, 67 nt, Human
uuguuugauuauuguuuuaauaguagagauggggacauuuuaugugucaaagcagugguccaaauga

SEQ ID NO: 4203085 - RNA, 76 nt, Human
uuguuugggaggaaagagaagugguccagaacuagagaaagaacauucugagacugucacuuuuccuuguaggcag

SEQ ID NO: 4203086 - RNA, 82 nt, Human
uuguuugggaggaagauggggaggaagaaaaggaaauaggaaugcuguguuccuucgucuucccuucauuucucccauguaa

SEQ ID NO: 4203087 - RNA, 75 nt, Human
uuguuuguuuuugagauggagucuugcucuguagcucaggcuggagugcaauggcaccaucucagcucacugcaa

SEQ ID NO: 4203088 - RNA, 101 nt, Human
uuguuuuaaguuauauuugaaaggaauuugcaggugugcuguguaagggaaauauuaugcacagcauguuuggagauagaguucaguguggcuuagagcaa

SEQ ID NO: 4203089 - RNA, 63 nt, Human
uuguuuuaauggcuuuagucacuucauuucuuuugaaguuucaugacuugguuauuaauucag

SEQ ID NO: 4203090 - RNA, 108 nt, Human
uuguuuucccuucuguuaaccucuaagcacacugccuugcugugcgcugacuucagaaaacuacagcuagagggcacgugaacgcugagcacagcagguaaagagcaa

SEQ ID NO: 4203091 - RNA, 82 nt, Human
uuguuuucuauauuuuuauuugacagaaaguaguucaaaagcaaaugaacuacuuuguggagauuaaaaauauagugagcaa

SEQ ID NO: 4203092 - RNA, 70 nt, Human
uuguuuugagauggagucuugcucugucgcccaggcuggaguucaguggcaggauuucagcucaguacag

SEQ ID NO: 4203093 - RNA, 78 nt, Human
uuguuuugagcugugcuauuccaaggccgggggaaugcuuaaagaaacccugaucuuggaauggcacagcugagacaa

SEQ ID NO: 4203094 - RNA, 98 nt, Human
uuguuuugcaggagucaugauuuccuuugaguuuuuaugucagcuucuuuaugcguuggcuggauaucagaggaaguguagcccacauugcugaacag

SEQ ID NO: 4203095 - RNA, 55 nt, Human
uuguuuugcaugauucagugguaauguaauaauugcucuugaauaagcauaauaa

SEQ ID NO: 4203096 - RNA, 75 nt, Human
uuguuuuguuucauuauauucaauguuuggcugagcccagugaaacaauuagaauguaaugaagcaucuagauaa

SEQ ID NO: 4203097 - RNA, 84 nt, Human
uuguuuuguuucugaaaauacuucuagguuagaguuuaagcuaaaaaucaauccuagcacugccuggaaggagagacauuacga

SEQ ID NO: 4203098 - RNA, 89 nt, Human
uuuaaaaguucauggaagccagauuucacucuuaauugaguuuaguugagaaacaugagaugugguuucuguuucugugaauugcuaga

SEQ ID NO: 4203099 - RNA, 67 nt, Human
uuuaaaaugugguggaaggauguucuuuuuuaaagacacuccccucucucuuuucacgcauuuugaa

SEQ ID NO: 4203100 - RNA, 100 nt, Human
uuuaaaauuauucaguguugccuucuuaagguuuugacucuuaauuaucguucauuugaaagacaagacuauguagaaaguauucuguuguucuuuugaa

SEQ ID NO: 4203101 - RNA, 62 nt, Human
uuuaaacugggauucuucacaaggugaugguagcauuaccagagggcaaaccccagugugaa

SEQ ID NO: 4203102 - RNA, 91 nt, Human
uuuaaagaaguuugacaaaguaaaaugacaauauccagauaagacaugggcauucuaaagugucuuuuaguuugugagaucugacuuuaaa

SEQ ID NO: 4203103 - RNA, 77 nt, Human
uuuaaagaucaguuucuaccauguggaaugcaugauaagguauauugaauugcacguucuuggaaauuaucucuaaa

SEQ ID NO: 4203104 - RNA, 62 nt, Human
uuuaaaguaaucugugugaauuuaucuuuggaaaauggugaacauucauugguugcuuuaga

SEQ ID NO: 4203105 - RNA, 62 nt, Human
uuuaaauagcucugguccucacccaccagccccugggucugugguggaccagugcugggaga

SEQ ID NO: 4203106 - RNA, 63 nt, Human
uuuaaauaguaggucuauuuuggccaaugauugaguuccaccauuguagcucugcuguuugaa

SEQ ID NO: 4203107 - RNA, 107 nt, Human
uuuaaaucugcauguggggacuacuuuaucucaguguacaggaugauaaaauggaaauuggugucacauucugaugugaggugagaaaccauaauguggaauuugaa

SEQ ID NO: 4203108 - RNA, 78 nt, Human
uuuaaaucuuugcuauguauuauugauaggaauugugucauuaggccauuccuaacuaauuuguagcaaaauaaugaa

SEQ ID NO: 4203109 - RNA, 76 nt, Human
uuuaaaugucuauuucuuuguuggacugaaaagaagugcauuguucucagcugaaguggagaagcagacagaugaa

SEQ ID NO: 4203110 - RNA, 77 nt, Human
uuuaaauuaguagaguaaaagaggugagauguaauugauaaaaacuaugucuauguucuuuacuguguuauuuugaa

SEQ ID NO: 4203111 - RNA, 112 nt, Human
uuuaaauuuacuaugaucuuugagacagcuuuaucuucaccugggaauugcuguuagacaauuaagguuaguaaagcucauugaauuucucagagggaagguguuauuugaa

SEQ ID NO: 4203112 - RNA, 55 nt, Human
uuuaaccaguuuacaaagaauuggucuuccacaauccaaaugggagcugguuaag

SEQ ID NO: 4203113 - RNA, 84 nt, Human
uuuaacucuauauugcugguggcucugauuucaugaugcauugugcuuaugaaacucuagcuuucagcacuaaaaugaguuaaa

SEQ ID NO: 4203114 - RNA, 74 nt, Human
uuuaacucuuugacaauucaugacauuuauaggccaacuccugagggccguauuggucagaaugucaaguugaa

SEQ ID NO: 4203115 - RNA, 83 nt, Human
uuuaacuuuugcaagcgaagcauaaugaugauugagauugaaagaucaaaucauugcauuaauguuugaacugugauauuaaa

SEQ ID NO: 4203116 - RNA, 60 nt, Human
uuuaagcacagggauaaaguuacccuucaggugguaaagucagagauccuuggcuuuaaa

SEQ ID NO: 4203117 - RNA, 128 nt, Human
uuuaagggauggaaaauaaugagugugaauguuagacuuuauuucaaaagagcuugggguuguuagaaaaucaccaaggcuuuaggaauuucuaccuuucagcuagaaucauugugauaaaugguaaa

SEQ ID NO: 4203118 - RNA, 63 nt, Human
uuuaagguugaaauagaugcgucagagauuuuuuuaagagcaucucugaaacugugccuugaa

SEQ ID NO: 4203119 - RNA, 91 nt, Human
uuuaaguaaagaaacaucugcccaaaaagcuuagguaacaagccuccaucaucauguggcuuuggcuuggcuuuugaucucuuuucucaaa

SEQ ID NO: 4203120 - RNA, 82 nt, Human
uuuaaguaagccuuaucucuaugaaucuccuggggcacuugaggcugcucacagugacuuacagagauugggcuucaaugaa

SEQ ID NO: 4203121 - RNA, 62 nt, Human
uuuaauagagaaugagacugagguaugagaaacaguuugguauuucagcauucucaguuaaa

SEQ ID NO: 4203122 - RNA, 70 nt, Human
uuuaaucaguuuuucaaaacaaacccuguuagaauugaauagcguggcaaauuuuggcaagcugaauaga

SEQ ID NO: 4203123 - RNA, 127 nt, Human
uuuaauguuuacuaugccucaagcguuuccuuugaugucaguaucauuccucucauuuuacaacugaggaaauacugggcucaaaaggguuaaaucacuuguccaaggucacauagaugucaauaga

SEQ ID NO: 4203124 - RNA, 70 nt, Human
uuuaauuauuucaggaacauuuaaccacagggccagcaggcuggauccugauauguguuucucaguugga

SEQ ID NO: 4203125 - RNA, 74 nt, Human
uuuaauucacuauuuuucacuuaggcuuauuagccuugcuuuuuuuaaguguaggggagaauacaugaauuaaa

SEQ ID NO: 4203126 - RNA, 95 nt, Human
uuuaauucucucucucagugucucuuucuauaaucuaccaugccagguguuugaugucuuggggaagguaagagggagugagggaggaaauugaa

SEQ ID NO: 4203127 - RNA, 82 nt, Human
uuuaauuguuaaugccauuaggaaauuuauuacuacugguggaaaugaucuccauaaauuacuuaagguuugacuaauugaa

SEQ ID NO: 4203128 - RNA, 72 nt, Human
uuuaauuuuauaccucuuuaaagacccuguauccaaauauacaagucacauucugagguauugggaguuaga

SEQ ID NO: 4203129 - RNA, 64 nt, Human
uuuacaagaaaucaugaugcuaaagcuugacacuaaagcuugaguauuguuaucucugaguaag

SEQ ID NO: 4203130 - RNA, 61 nt, Human
uuuacacggcauuaucuucaugucaagaaagacgucuuugagaugacaugccuguuguagg

SEQ ID NO: 4203131 - RNA, 74 nt, Human
uuuacagagauaauuaguuuaagaugagguuauuagaauggguccucauccaguaugacuggugucuuuauaaa

SEQ ID NO: 4203132 - RNA, 68 nt, Human
uuuacagagccuggccagcccugaccugccccucccauccuggggcugcaggguccaggcccugugga

SEQ ID NO: 4203133 - RNA, 59 nt, Human
uuuacagcacugaagccaggggaauuacguggucccuccccugguguuuggaguuugag

SEQ ID NO: 4203134 - RNA, 58 nt, Human
uuuacagucucuauagucaaaagugaucaauuccacuuuauucuguugguccuguaga

SEQ ID NO: 4203135 - RNA, 58 nt, Human
uuuacaguuccaugugauaggcacggugggcuggggccggaucaggggagucugugga

SEQ ID NO: 4203136 - RNA, 59 nt, Human
uuuacaugaguagcagauguucugaaggugaaagucauguacucugucuauucagugaa

SEQ ID NO: 4203137 - RNA, 81 nt, Human
uuuacaugugagaaggagguagcucaggugaacagagggaugacuuugaguucuguguauccuuugucccacacuugugaa

SEQ ID NO: 4203138 - RNA, 59 nt, Human
uuuacauuuccugucagagauauaacaaaaugcucucuuguuguaauaggaaguguagg

SEQ ID NO: 4203139 - RNA, 61 nt, Human
uucucaguaguuagcauuugugaauuggccuccuuugauuucugaugaggcugucugagaa

SEQ ID NO: 4203140 - RNA, 56 nt, Human
uucucauaugcacucuauuugacaaucauuauguuagacuggaagucauuugggag

SEQ ID NO: 4203141 - RNA, 62 nt, Human
uucucaucuaaggagggaggugucuccaagaaaccaagccauucccuccugcagauagagaa

SEQ ID NO: 4203142 - RNA, 57 nt, Human
uucucaugaugcaauucauccccagccacuuaucuggccaugaaauaucaaugagag

SEQ ID NO: 4203143 - RNA, 68 nt, Human
uucucauguaaaugccaucauccugaucuuucuuucaggaucacuaguaauauggcauuuaucuggaa

SEQ ID NO: 4203144 - RNA, 55 nt, Human
uucucauucagucuuccuuaauuucacugugaaugauaaaggaagaggaagggaa

SEQ ID NO: 4203145 - RNA, 56 nt, Human
uucuccauaucugugcugauucaccucacacuagaucagugcaauucuauggggaa

SEQ ID NO: 4203146 - RNA, 62 nt, Human
uucucccugugccucugaagggcggacggcguugugucugcgcaguccugcaggcgggagaa

SEQ ID NO: 4203147 - RNA, 74 nt, Human
uucuccuauuuuauaguccuaguaguuaugaaucuugaaaaguuaagccugagugcuuaggacuguuuagagaa

SEQ ID NO: 4203148 - RNA, 130 nt, Human
uucuccuuaacuugucgaauucuaaugcuaauuuccuguauuucugguuaaaugugcuaagcagucuuagcucuaucacuuguguaucagagaugagagguggaggaguuuuuucgauaucuaaauggaa

SEQ ID NO: 4203149 - RNA, 98 nt, Human
uucucguauuuuuucuaccuuuugcuuauuaugacacucuauuauccaaguugcccaaguguguccaguaauauaaaaggaguuguugaaauucagaa

SEQ ID NO: 4203150 - RNA, 77 nt, Human
uucucguuuaugugaugcaucccagaaaaaugacaugaccauaacauuuuugagaauuguaucauauaagaugggga

SEQ ID NO: 4203151 - RNA, 65 nt, Human
uucucuaccuuuuacuagugccaugauugugggcaaaucaccucaugucaucaguaaaaugagga

SEQ ID NO: 4203152 - RNA, 62 nt, Human
uucucuacuaacugucacuucugcacaucuguugcccaaauaugauuggcgguuguagugaa

SEQ ID NO: 4203153 - RNA, 61 nt, Human
uucucuaggaguucugggaucauuccucacccagugagggcuuuccuaagauuugugagaa

SEQ ID NO: 4203154 - RNA, 74 nt, Human
uucucucaaacccuuuucagaguugauaucauucccacaugggaugaggagucgagaagggguaauuuagagaa

SEQ ID NO: 4203155 - RNA, 129 nt, Human
uucucucaucuugcucugcuuuuucuguuuucuuuguuuguuuguuuuccaggaagauugcaagaugccuggucuuuuucuggaagaguaaaauaagcccugagaagaggggcagguauaggagaucaa

SEQ ID NO: 4203156 - RNA, 59 nt, Human
uucucuccuccuagaggcuuuugugauuucugucaccuuuguguccugggaggagagag

SEQ ID NO: 4203157 - RNA, 70 nt, Human
uucucuccuuuaucugcucagaaaguacaggguguucuguuucuccugugcauacagaucaaggagcgga

SEQ ID NO: 4203158 - RNA, 55 nt, Human
uuucuguuucuggggucucugacagugacugguccugucuucccagcagcaggaa

SEQ ID NO: 4203159 - RNA, 116 nt, Human
uuucuguuuugcucucucacagccccacugucugcaggccucagcauguguaaccccauucugcgucugcuccugggcuuggcuggcuggucuggggugagaggacagagcagggg

SEQ ID NO: 4203160 - RNA, 71 nt, Human
uuucuuaaaagucauugaaaaauguauagcuagaguuaugucucuaugugcaaauuaauugcuagaagaaa

SEQ ID NO: 4203161 - RNA, 65 nt, Human
uuucuuaauuucugucugacaucccugccucucuggggagguagagguaggaaagaauauagaaa

SEQ ID NO: 4203162 - RNA, 77 nt, Human
uuucuuacuugcuacgugugugacauugggaacgugauuuaccacccaauauguugucauaugugaaaaguaggaga

SEQ ID NO: 4203163 - RNA, 81 nt, Human
uuucuuagcauuuuagugguguaggucuggaaggauccuucaaggggcaucuaauccaguccagcaucgugcuuauagaga

SEQ ID NO: 4203164 - RNA, 76 nt, Human
uuucuuaguaggugugcauguggaagcauguaugugagucuucuauauucugcuuuugaugcauucauacuggaaa

SEQ ID NO: 4203165 - RNA, 73 nt, Human
uuucuucacaaauuucagcucccugaaaguuagguaaauaucuggaguuugagcugcaguuugcuugaggggg

SEQ ID NO: 4203166 - RNA, 87 nt, Human
uuucuuccccaguggacuuuaaaaugcuagaacaggggccauuuugcacccuguucuagucuuuacagugaaagggacaaauagaaa

SEQ ID NO: 4203167 - RNA, 57 nt, Human
uuucuucugucuccugcauguggaguuaaaaguguuaccugucuggagacaaagaga

SEQ ID NO: 4203168 - RNA, 75 nt, Human
uuucuugaagcugggggagcauuauuuauguagauugaaacaaaugcugaaugugcucccuuuuaaaaugagaaa

SEQ ID NO: 4203169 - RNA, 72 nt, Human
uuucuugccuguucauuuugaaguggaggaauuuucauuuucaaguuugaacaggaaauucuacucaggaaa

SEQ ID NO: 4203170 - RNA, 70 nt, Human
uuucuugcuauagcaagcuuugagcuuucagagaacuuauauuugaaaacuggaucuucuauggcagaga

SEQ ID NO: 4203171 - RNA, 64 nt, Human
uuucuuggggcuccugcgccauucucccaggaaagugaggcgaaggugcuggcgccccaggaga

SEQ ID NO: 4203172 - RNA, 73 nt, Human
uuucuuguaagguagacuuccaacaaauguuggaugucuaacaaauguuggauuugucuuccaauaaaagaaa

SEQ ID NO: 4203173 - RNA, 61 nt, Human
uuucuugucuuuaguaucuggcuucucaacuuuuucaccugccaucuugcaagaugagaaa

SEQ ID NO: 4203174 - RNA, 69 nt, Human
uuucuuuacugaauuugguauauuccauuugcaaugauuuaacaaggggaauaggaccuucaggagaag

SEQ ID NO: 4203175 - RNA, 62 nt, Human
uuucuuuauccuccuuugcacauggccaaacucaggcucagcaacacagaaggcuaaaggaa

SEQ ID NO: 4203176 - RNA, 71 nt, Human
uuucuuuccccaugaacauugcagggaugugacucggugucacuuaggugaugugcaugacaugagggaaa

SEQ ID NO: 4203177 - RNA, 60 nt, Human
uuucuuucuuuuuccuggccaugaggacaaaaauuacugaguggcccuuaaagagggaag

SEQ ID NO: 4203178 - RNA, 79 nt, Human
uuucuuugcuguuugugaaaugaagaaagaucaagucagugaaaaacaggcuuucuggaaguuggaaauagcagagaaa

SEQ ID NO: 4203179 - RNA, 58 nt, Human
uuucuuuggcacagucucauuugauguucacaucagcucuggcugaguuagucagaaa

SEQ ID NO: 4203180 - RNA, 108 nt, Human
uuucuuuuacuuugccauagcuuaaaagcucuugcucuaguggccccugaaugcaaaacaagcauugccuggccacaggcaugcuuggccauggcugguaaugagaaa

SEQ ID NO: 4203181 - RNA, 66 nt, Human
uuucuuuucucauggacccuucaugauguauccuuuuuccaucugccaaugccaugagaagagaaa

SEQ ID NO: 4203182 - RNA, 120 nt, Human
uuucuuuucugguagggagauacaaaaagggagaugagguagauuuaauaauaaaaguacugaaggucucugacucagccucuuuuccuauuccuaaacaugccaaaauaaaugaggaaa

SEQ ID NO: 4203183 - RNA, 71 nt, Human
uuucuuuugcucuugcuuuuucuagaaagaugacaacauccuggcuguuagagaggcaaggaaaggagaga

SEQ ID NO: 4203184 - RNA, 129 nt, Human
uuucuuuuuuguuguugcuguuucuaaagaguaaaugccuuuuuaguucuuggaucaugcagacucugcuguauugcacaugcgcuagaaccaggcacuguuuaguaauggagugacaguuauuuauua

SEQ ID NO: 4203185 - RNA, 130 nt, Human
uuugaaacuuuuugcuaaaauucucuugugcugacuuguaaaauauccaguuaaggugguacuguaaauucacguuuugccuucugccuuacuguauauacagaauagccaaagaauaacguauaacaaa

SEQ ID NO: 4203186 - RNA, 87 nt, Human
uuugaaagccuucagaguuuuaucauacguggauaaaacucauaaugcaaauuauccauguaugauacaacucagaaggcucucaga

SEQ ID NO: 4203187 - RNA, 59 nt, Human
uuugaacagacacuuucuacaguacuuaugagucaaggcuguucacugugcugugcaaa

SEQ ID NO: 4203188 - RNA, 97 nt, Human
uuugaagaccaaguucugaacauggcccgcgauuuggcaaauacuuagucauugaaugcugaagagcagggacaucuucagaucacuucucuccaaa

SEQ ID NO: 4203189 - RNA, 88 nt, Human
uuugaagcaaugcauucaugaagauugcacauucuggcauacuuaguaauuucacaguaauaaugagucauuccugaaugcuuucaaa

SEQ ID NO: 4203190 - RNA, 64 nt, Human
uuugaaguguaugaaaauacagguugucuggggacguuguucugauauuuucauauaggacaaa

SEQ ID NO: 4203191 - RNA, 62 nt, Human
uuugaauguacaugugaauuuaggcaauggaaaacacauuuugccugcacuguauauauaaa

SEQ ID NO: 4203192 - RNA, 88 nt, Human
uuugaauugucccuuauuauuucaccuagcugccucuagcaccuugcuugggcagguaggugaaauaaugagggccccucuuuucaaa

SEQ ID NO: 4203193 - RNA, 64 nt, Human
uuugaauugucuguggguugcaaggcugccaauuuucagaaguuugcaccaugauaaauucaga

SEQ ID NO: 4203194 - RNA, 78 nt, Human
uuugacacagcagacuggaguaggcagugcuguuuuucccuagcccuggcauucugcuugagucucaacuguuacaaa

SEQ ID NO: 4203195 - RNA, 64 nt, Human
uuugacaggacuaacauauggcuuuggauuucuggccaaagacuccuccaugguuccuaucaga

SEQ ID NO: 4203196 - RNA, 105 nt, Human
uuugacuucuguggucagaaucuuucccucuuuuaugagcaugagauacuuccugcuaacuuauguaaaacggaaagggaauugaugucauaccacaguguugaa

SEQ ID NO: 4203197 - RNA, 60 nt, Human
uuugacuuucugaaucucugcacagucagaaaucuggcagaauaaucacugaaguucaaa

SEQ ID NO: 4203198 - RNA, 82 nt, Human
uuugacuuuugaugugugaauucuuaaaugugcacaaaccaaagacaauggcauauauacuuugacacauucugaaguuaaa

SEQ ID NO: 4203199 - RNA, 66 nt, Human
uuugagaaaugcugcucuugguuaauuucuugaagagaagcugacagaugcagcagguguuuugga

SEQ ID NO: 4203200 - RNA, 63 nt, Human
uuugagcaaaaacaguuuaaauucuucuuagaaggauucacagacagcugcuuuuggcuuaaa

SEQ ID NO: 4203201 - RNA, 60 nt, Human
uuugaggaacaucugcuagauaugucauuccaguggcauuuuacaggucaguuccuugaa

SEQ ID NO: 4203202 - RNA, 63 nt, Human
uuugaggaggacagaaacauuuaauuguugaguaauacuucuuaaaugauguuuuaccucaag

SEQ ID NO: 4203203 - RNA, 88 nt, Human
uuugaggguuaauugucaugucuauuguaccccaggcaagcaccauccugcugaguacaaaguggaccugauaguaaagccccucaga

SEQ ID NO: 4203204 - RNA, 78 nt, Human
uuugagguuaguuuauaauucauuucugucuguugugccuaaaaucuuggcuauucagaaugaugacggcuccucaga

SEQ ID NO: 4203205 - RNA, 82 nt, Human
uuugaguaagcacuugugugucuucuucacugcccuagucucugugccuagagcagugucuggcacauacuagaugcucaga

SEQ ID NO: 4203206 - RNA, 62 nt, Human
uuugagucugcuuccauuuucacuucuuggcacugccugugugagugggaaggggacucgga

SEQ ID NO: 4203207 - RNA, 71 nt, Human
uuugauaauggccgcuaugagucaccugcagaguagaacuguguguauccauuagaggccaagacuucaaa

SEQ ID NO: 4203208 - RNA, 88 nt, Human
uuugaucagcauggcuagucuuacagugcauucuuugaaaaagaagaaauacugccuaagacuguaacacaacaauuugcuaaugaga

SEQ ID NO: 4203209 - RNA, 55 nt, Human
uuugaucuaugcgugguuucccaguuugagauggaggaucaugacaagggacaaa

SEQ ID NO: 4203210 - RNA, 69 nt, Human
uuugaucugcacacaccgugcuucacugauggaaucaccauguggccugggaaaugaguguugaucaaa

SEQ ID NO: 4203211 - RNA, 93 nt, Human
uuugaugggccuaaauucaguuauauguccacuuccaaaccauuugcuguggccaagggaagagggcaugauaauuagcuugagccaaucaag

SEQ ID NO: 4203212 - RNA, 76 nt, Human
uuugauggucuuaagaagcaguuaacaugacuugaaagcaacauuuuucaaguacuguaaacaugcuaccauggaa

SEQ ID NO: 4203213 - RNA, 85 nt, Human
uuugaugucacauauguucuccaugggugggauuagcugugcuaagccucacugucaccagcccugauuagagaaugucaucaaa

SEQ ID NO: 4203214 - RNA, 55 nt, Human
uuugauguuacaaggugccuaaacuguuaucagugcugggaaaguaacauacaaa

SEQ ID NO: 4203215 - RNA, 98 nt, Human
uuugauuaaucuucuuggauuuuggaagcaguguacacuguacuugaaccaguuuaucaggugaccagaaaggcuuccauuuucaagugggauucaga

SEQ ID NO: 4203216 - RNA, 100 nt, Human
uuugauuaugcaacauucuuggugaaaagcugguugucauucagaauugauuucuguauaguuuugaauuuauaaccaugaagaauagcagcugauuaaa

SEQ ID NO: 4203217 - RNA, 61 nt, Human
uuugauuugcaguuuugguuucauaucuuuuuagaggugauacccuuuggcugcgagcaaa

SEQ ID NO: 4203218 - RNA, 67 nt, Human
uuugauuugcuuguucaccaguacuuuuggagcagaaugucaggaguaugugaggaaguaaagaaga

SEQ ID NO: 4203219 - RNA, 67 nt, Human
uuugcaaaagcugcugccaaucaggcuugccuaucuuugcagggcuaauuaacagcacuugggcaag

SEQ ID NO: 4203220 - RNA, 65 nt, Human
uuugcaaacagcuaccuucucacugugcccuaacaugggaaccaggaaauggagcuguuaucaag

SEQ ID NO: 4203221 - RNA, 118 nt, Human
uuugcagguaggcaguaaacuauaauagcuaugguggaagaggcucaggaauuaauugaguaguuucaaauccugauucugccacuacuagccuuugaaaugcuuugccacuugugaa

SEQ ID NO: 4203222 - RNA, 89 nt, Human
uuugcaguuuuuagucuagauuaaauuaauugguggugguuuucauuuaaucacacuaaucuuuuauuugguuucuauaaugucgcaaa

SEQ ID NO: 4203223 - RNA, 56 nt, Human
uuugcaucauucagugccuugggaaugucuuacgggauauuucuggaaugggcaaa

SEQ ID NO: 4203224 - RNA, 80 nt, Human
uuugcaugcuugugauguccugucuacauaacugugugaauuagaaaagucuacacaucccugaggacagaagaugcaaa

SEQ ID NO: 4203225 - RNA, 61 nt, Human
uuugcauuccugccugcauucaguagauaaacaaagaaagagcaggucccuggcaugcaga

SEQ ID NO: 4203226 - RNA, 84 nt, Human
uuuggaccgggcaagguggaucaugccuguaauccuagcacuuugagaggccgaggcaggcagaucaccugucaggaguucaag

SEQ ID NO: 4203227 - RNA, 55 nt, Human
uuuggagaggagaagucgaaguuagaaugccuccauguugcuucuuuucucuagg

SEQ ID NO: 4203228 - RNA, 74 nt, Human
uuuggagauuaauauugaaagcugugcuuaaucuggauaucaucaagaaucugaugcagcuucucaucuucaaa

SEQ ID NO: 4203229 - RNA, 63 nt, Human
uuuggagggucagagcaagacuggggucaaugauggccccaggccuuuggucuggcaacuaga

SEQ ID NO: 4203230 - RNA, 55 nt, Human
uuuggaggugugcaaaauauuucauaaugaaauagcauuuuuguucaucuucaaa

SEQ ID NO: 4203231 - RNA, 61 nt, Human
uuuggaucacacaugcacuguuugagacaaauuucaagcugcaucagugcagugagacaga

SEQ ID NO: 4203232 - RNA, 78 nt, Human
uuuggauccucuucagaucuggugaaguuauaguauaaaaaagcauacuggcuagcguaucugaacaauggguucaag

SEQ ID NO: 4203233 - RNA, 83 nt, Human
uuuggaugacucuugcacuguucuuuccaaauuccccaggugugaaaauuugagggauuuuaaaugaacaaguaucagccaaa

SEQ ID NO: 4203234 - RNA, 76 nt, Human
uuuggcagagaguaugcugaagaucaugauaucaacauaaaaaguuguucuuuuucauuuuuaguuuucuuccaaa

SEQ ID NO: 4203235 - RNA, 56 nt, Human
uuuggcagcuuccauauucacuuguuuuucuccccagugaaauggcaguugcuaaa

SEQ ID NO: 4203236 - RNA, 80 nt, Human
uuuggccaauaucucuggcuuggugccuuacuuauuacagaauuguuauucugcaggaucagagccagaggcaggccaaa

SEQ ID NO: 4203237 - RNA, 66 nt, Human
uuuggccagggaggaaugucccuuuguucuucuucccccugagaagccauuccuuugucugccaaa

SEQ ID NO: 4203238 - RNA, 60 nt, Human
uuuggccuuggucacaguucccaacauugaauaacaacucaauguauaugugaccccaaa

SEQ ID NO: 4203239 - RNA, 59 nt, Human
uuuggcggggcaauucugaagcagcuuccacgugccuucucagaagcuccccagcuaaa

SEQ ID NO: 4203240 - RNA, 107 nt, Human
uuuggcuaagaacuuugggacuuuuuguuggcuuaagaaauacaguuauuaugcuaguuaacuuuauuuuaaagacaguuuugcaaaauucaguucuauggcacaga

SEQ ID NO: 4203241 - RNA, 88 nt, Human
uuuggcucagaucuuauuauuguuguaaaagcaaggccgaagcaugaaagccuuguauuugaaacagugcauggguuuuguuaccaaa

SEQ ID NO: 4203242 - RNA, 55 nt, Human
uuuggcucauugcucuugccugugaauuaccuucugaggcaaccaaugaggcaaa

SEQ ID NO: 4203243 - RNA, 91 nt, Human
uuuggcugcuuuuuccccacuucgcucauguauuuuccagccugaaacagacuucuugggaaagaaugagaaggugagguauggcuuuaga

SEQ ID NO: 4203244 - RNA, 69 nt, Human
uuuggcuucaggauggagggaagcacagaaauuucaagauuucugacugcuugauccuccugugugaaa

SEQ ID NO: 4203245 - RNA, 81 nt, Human
uuugggaagacuuauuauugugaccugagaauguaauuugaauaugugggacagggacagugauauuucuauagucccaga

SEQ ID NO: 4203246 - RNA, 94 nt, Human
uuugggacucauuuacacaaaguuagcucuugcagcugcaggcuaugugacugccuagcaagagugggcuuugugggaauuggagugucccaga

SEQ ID NO: 4203247 - RNA, 70 nt, Human
uuugggaggcaguuugugaaggagcccaaaacugugaggcuuccugcugggcucugucaugccuuccaag

SEQ ID NO: 4203248 - RNA, 92 nt, Human
uuugggaggcugaggcagguggaucacgaggucaggagaucgagacuauccuggcuaacacggugacaccccgccucuacuaaaaauccaaa

SEQ ID NO: 4203249 - RNA, 68 nt, Human
uuugggcauauagcuguucccuucucugguuggaaacucgucagucagguacagcguaucugcccggg

SEQ ID NO: 4203250 - RNA, 103 nt, Human
uuugggccaguuucuuacauucuuugggccacuuuaguuuccuuauugaaaaauggggauaauaauaguggcuacaucucagugugauucugaggaaaccaga

SEQ ID NO: 4203251 - RNA, 62 nt, Human
uuugggcuggagaugaucugcuguaguugucacucucagucuuugaugcauccuagccugag

SEQ ID NO: 4203252 - RNA, 127 nt, Human
uuuggggcagguaagauccagaccauguacaaaagcaucucucacucucugaauggauauauuucuaauuugagauaguaagaguuuggauagugagagauacuuauaucuggaaaaaccucccaaa

SEQ ID NO: 4203253 - RNA, 79 nt, Human
uuuggggcugccaccagcucuccacccuccugguuccgcuggccgggccaagagaggauggagggaugggagucccagg

SEQ ID NO: 4203254 - RNA, 114 nt, Human
uuugggggaaacagaggaggcaauggcucaccccugucagagaggaucaacaacaugcagacauuccuuauuaugagagauggguaacuggagucugcuuacccuacuuccaaa

SEQ ID NO: 4203255 - RNA, 94 nt, Human
uuuggggugacgcaccaaaccuugaaccaaucacuguagccagagagacaggugcucugguuugaccugguuuaugucagucgugugcccugga

SEQ ID NO: 4203256 - RNA, 89 nt, Human
uuuggguaguugauuucuguugaaacuaauuuccuuaagacauuuaucuuuuggaaauuucaucaauagccuguuugagacuaucugga

SEQ ID NO: 4203257 - RNA, 106 nt, Human
uuugggugcuuauuaaaaaugcaguuuccuggucucuacuucaagccuauuaauccaagcucucuaaguggagccagggaaacugaauguuaacaaacuauccagg

SEQ ID NO: 4203258 - RNA, 113 nt, Human
uuuggguguuauuuuugucuuacagguacaugucaaaaaaugcauaacacugaaauaacagagauuuaggcauaguuuugauaaauacacuaguauaauuagaauaucccaaa

SEQ ID NO: 4203259 - RNA, 127 nt, Human
uuuggguugucguggcugugggaggggagggagagcuuccuggcaucuguguagagaggcgaggcuuguugcuaacacccuccagugcgcaggacagccccagccccagccccagccccagcgaaga

SEQ ID NO: 4203260 - RNA, 113 nt, Human
uuugguaaauaacauaaaaccugaagguuuuguuugcaaaucaugucaguugccuucauaaauguacagguaaugauuuguuaacagacuuaaugaagguuuuaauuaccaga

SEQ ID NO: 4203261 - RNA, 83 nt, Human
uuugguagugguuucuuaggaaugagauuucuagugagcuugauguuuuucucucugaaauucauuccuaguggcauaccaaa

SEQ ID NO: 4203262 - RNA, 55 nt, Human
uuuggucaggguaggacaguugcauauuuuuaguauguaggucuaacugacuaaa

SEQ ID NO: 4203263 - RNA, 64 nt, Human
uuugguccuaagcugcucucuagcaugaugauccuagcuuuaaagagggaaacagcaggcuaag

SEQ ID NO: 4203264 - RNA, 63 nt, Human
uuuggucucauucacucaugggcacccuucuguuucgugguugccuguuggaugagguccaga

SEQ ID NO: 4203265 - RNA, 88 nt, Human
uuuggucugagcucaaaugauuggcuccugauuguccuguggucuagggaauuccuggggaagucggagccugagcaccagcacugag

SEQ ID NO: 4203266 - RNA, 60 nt, Human
uuuggucuuccaggggaagaauuuuuguaauaagcuugguucuuuccccagaggacuaaa

SEQ ID NO: 4203267 - RNA, 88 nt, Human
uuuggucuucucuugccugagaucaaagucagacuggaacuuacaccauaggcuuuccugauucucagguuuucagacuuggacugga

SEQ ID NO: 4203268 - RNA, 80 nt, Human
uuugguguauauacugauccuuugacuuuguugagaaauguagggaaguaguaguaagaggaccaaauauauacauggaa

SEQ ID NO: 4203269 - RNA, 61 nt, Human
uuugguuuuuaccugcugagagccaucuuucaaggcuaguuucuaguaguuagagaccaaa

SEQ ID NO: 4203270 - RNA, 72 nt, Human
uuuguaaaaagguaaauuuauaguugaauuauuuguauagguaagucuuaugugauuuaucuuucuugcaaa

SEQ ID NO: 4203271 - RNA, 130 nt, Human
uuuguaaaauuucucuccaggauaaauacugugguguucucugagguguauauuuuggacaaaagucuuuccaaaauuauuacauuuguaggguuucuauccaguaccgauucuuuaauuuuuaguaaga

SEQ ID NO: 4203272 - RNA, 93 nt, Human
uuuguaaauuuugacuuugaaaggccauuguaauguaaauaugacuuccuagaguguaaacaacagugguuugaaauuaaaaauuuguacaaa

SEQ ID NO: 4203273 - RNA, 79 nt, Human
uuuguaagcacaagccagaagugugugguccauuuucucuuuaauaagaaaugccagcacacgucuguggacucgcaga

SEQ ID NO: 4203274 - RNA, 65 nt, Human
uuuguaagccuaaugcccagcaucugucuccugggcaucuguguccugggcauuaggcuuagaaa

SEQ ID NO: 4203275 - RNA, 62 nt, Human
uugcaaccuguacuuacuaaauccugguggaaaccacaguuugguugcuacaguaaaugcaa

SEQ ID NO: 4203276 - RNA, 67 nt, Human
uugcaagaugacuuucccaaagguuguauuccuacauuccuacaagcuuauuaaguuaucugugcaa

SEQ ID NO: 4203277 - RNA, 76 nt, Human
uugcaagcccaggauccuacguuugaauggcaggugaauuacauauaccgacaaucacugggauauugguguguaa

SEQ ID NO: 4203278 - RNA, 92 nt, Human
uugcaaggaaaagccacuuggggaaagauggaaaaggacaaaaaaauuaauaaauuuccauuggcccucgggugagcugaggguuuuugcaa

SEQ ID NO: 4203279 - RNA, 101 nt, Human
uugcaaggcccagcccaggcacaggccucagcacccaggcaggcucagagcacuugagguuggaggccuugccuggcuagaugcucagcuguggccuguga

SEQ ID NO: 4203280 - RNA, 91 nt, Human
uugcaagggagcuggcaggaggcuccccgagacgaagcagguaaauguacucucaccugcugauugaugaguguccuguagcccuuggcag

SEQ ID NO: 4203281 - RNA, 63 nt, Human
uugcaaugccucaauuaaagccacuguacuuuucuaugugcagggccuuagggagggcuguaa

SEQ ID NO: 4203282 - RNA, 56 nt, Human
uugcacccauagcacacacuccuugcuaaaagccuaggaggacugugaugggucaa

SEQ ID NO: 4203283 - RNA, 61 nt, Human
uugcaccuccccuuuauaaaucuuuccauuuauuucugacucagguuuauggggaggguga

SEQ ID NO: 4203284 - RNA, 62 nt, Human
uugcagaauauauuacugagccuccugaagaauaggaaguuaucaaagauguauucucucaa

SEQ ID NO: 4203285 - RNA, 58 nt, Human
uugcagacagugagagugaaagguguuuuauucuuacuauugacucucaaauuugcag

SEQ ID NO: 4203286 - RNA, 60 nt, Human
uugcagauauuuccgaugcuauacaagauauaucucauaguauggguguagauucugcaa

SEQ ID NO: 4203287 - RNA, 70 nt, Human
uugcagccaaagagguucuccuuggaguggggucgccuccaaaccccaaauucccggcgcuucucugcaa

SEQ ID NO: 4203288 - RNA, 57 nt, Human
uugcagcuucgagucuaucuguggggacucagcuuuuucaauaacucuaggcuguaa

SEQ ID NO: 4203289 - RNA, 63 nt, Human
uugcaggcuccccauugaucugcaggcuacaucagccuaagaugaguggggagucuuaagcaa

SEQ ID NO: 4203290 - RNA, 55 nt, Human
uugcaguccaagagucuccuggugcucuuguacugugugcucuugacgacuguga

SEQ ID NO: 4203291 - RNA, 75 nt, Human
uugcagugauuugcacucugccuuucagcagaugaacaaaagugacagacauggaagccagaguuguggcugcaa

SEQ ID NO: 4203292 - RNA, 65 nt, Human
uugcagugucaucuagacgugguagaaaaauagauauacccaugccauguucugaauuacuguaa

SEQ ID NO: 4203293 - RNA, 57 nt, Human
uugcaguuuguggcaacuuugaucacauaggaaugauuccugguagccuuacugcaa

SEQ ID NO: 4203294 - RNA, 55 nt, Human
uugcauaacagccauuaaaguauuaguauuacuuugggggcacuugauuaugcaa

SEQ ID NO: 4203295 - RNA, 62 nt, Human
uugcauaaugugggagaccuucccuaccccaggaaagcuggagagugaaggcuucccagcaa

SEQ ID NO: 4203296 - RNA, 55 nt, Human
uugcauauucaugucggcugaaaaagcaguuaaaugcuggcugaacugaaagcaa

SEQ ID NO: 4203297 - RNA, 60 nt, Human
uugcaucagguagacaacuauaaugauauaaguaagcaauaguugagaaccugacagcaa

SEQ ID NO: 4203298 - RNA, 64 nt, Human
uugcaucucaucaagccuagaccuaugucccaguuuacaggagguucaggagauggaggaacaa

SEQ ID NO: 4203299 - RNA, 62 nt, Human
uugcaugcaaaucuuaaguauguguguauaaauauacauauacugagugauuugcuuugcaa

SEQ ID NO: 4203300 - RNA, 77 nt, Human adenovirus A
aucgcgaugguaaucuugguucgcuaguagcauuaaacgcuuuuuugaguacucagccggcuaauguuccgcguggu

SEQ ID NO: 4203301 - RNA, 83 nt, Human adenovirus A
acggucauuuccaggccaacucacggaggagucaaacaugauugacaccuucuuaaaagugugguuuagguaaaaggugccgu

SEQ ID NO: 4203302 - RNA, 73 nt, Human adenovirus A
gucauugccagcguccggguucacuacaguguaugucagcugggaugcuuuugggacgcugguucaaaauggc

SEQ ID NO: 4203303 - RNA, 62 nt, Human adenovirus A
gucuacggcuaggggcuguggcucggcgcugaaaaguugucccacgguacccaggcgugggc

SEQ ID NO: 4203304 - RNA, 86 nt, Human adenovirus A
gacuuaaugaacaaugcuauuauugagcauuauuugcgaguaggaagacagcauggagugcuggaaagugacauuggaguuaaguu

SEQ ID NO: 4203305 - RNA, 113 nt, Human adenovirus A
gcggcuuguucuagcaguauuugguuacgccgggcucguaccccauucacccuggaaaucaugugggguccggcgcuuaaccaauucauuuugcuagaauagucuugagccgc

SEQ ID NO: 4203306 - RNA, 63 nt, Human adenovirus A
ggaugaguguauggaaaauuugggaagucacaaaggcguuuccaaguuuuuccaugccuuucc

SEQ ID NO: 4203307 - RNA, 56 nt, Human adenovirus A
gggcgcucuuguguuaagugugagggcacuagccuuuacugcuaggggggcgcucc

SEQ ID NO: 4203308 - RNA, 66 nt, Human adenovirus A
gugguuguacuuugcuuuuuugacggaacgccaacgcugcaaacaaaaaggacgaggugcgauaac

SEQ ID NO: 4203309 - RNA, 66 nt, Human adenovirus A
ucacuugugcucauagcggauccugccgguuucgaaccgggguuccucgcuaugguacccuuguga

SEQ ID NO: 4203310 - RNA, 70 nt, Human adenovirus A
ugguauccaauguuguaaugacuaagcauuuguauuaggaaccaauccuuagucauauugcauugggcca

SEQ ID NO: 4203311 - RNA, 106 nt, Human adenovirus A
cagcugagcaguuagaguuucaagcuuggcaagcauaacagucagaauguccucucgaacugcggugcgugucacagcauucgaagccaagugauuguagaagcug

SEQ ID NO: 4203312 - RNA, 59 nt, Human adenovirus A
ugaaagcacuggcggguaccaagggucuguuugcacgcuugcguucaccguuguuuuua

SEQ ID NO: 4203313 - RNA, 60 nt, Human adenovirus A
uugcugcuggcuucugauuuguaugauuuuauacaacuggcauuaagaugucagcugcga

SEQ ID NO: 4203314 - RNA, 73 nt, Human adenovirus C
cagaccccccaucuauaggccuaucauugugcucaacccacacaaugaaaaaauucauagauuggacggucug

SEQ ID NO: 4203315 - RNA, 58 nt, Human adenovirus C
cggcagcugcagcuucuuuuugggugccauccugggaagcaagggcccgcggcugcug

SEQ ID NO: 4203316 - RNA, 69 nt, Human adenovirus C
gaccguccaaucuaugaauuuuuucauuguguggguugagcacaaugauaggccuauagaugggggguc

SEQ ID NO: 4203317 - RNA, 60 nt, Human adenovirus C
gagcggugcggggugcauagguugcagcgacagugacacuccaguaggccgucaccgcuc

SEQ ID NO: 4203318 - RNA, 98 nt, Human adenovirus C
uucugcagacuaacuuugccugggaggagccccacagaaaccuccaaaaccaagagguacuguuagagcucuguuccagcaaguuacgcacagcagaa

SEQ ID NO: 4203319 - RNA, 60 nt, Human adenovirus C
uugccacugccacagagggcauggagacacaaacguccccgguugccucggcgguggcag

SEQ ID NO: 4203320 - RNA, 71 nt, Human adenovirus C
cauccccgcccuguucggugucaucuuuuaagcuugccugguaggcguccacauccaacagugcgggaaug

SEQ ID NO: 4203321 - RNA, 80 nt, Human adenovirus C
ccacugucauuguuccagucccgguucccugcagugcauagccggcgggcagguuuuggccagcugguuuaggauggugg

SEQ ID NO: 4203322 - RNA, 62 nt, Human adenovirus C
ccuccugcuguugcuccuccgucgguauuauugccgggcggacggaagacaacaguagcagg

SEQ ID NO: 4203323 - RNA, 67 nt, Human adenovirus C
cuccuagccgcgccaggcccucgcccuccuccaaguccagguagugccgggcccggcgccgcggggg

SEQ ID NO: 4203324 - RNA, 58 nt, Human adenovirus C
cugaaagcaauguaauugggucuguuuggcauagauuguugacccaacauagcuuuag

SEQ ID NO: 4203325 - RNA, 70 nt, Human adenovirus C
gcgcucgaucaucuccccgcggcgacggcgcauggucucggugacggcgcggccguucucgcgggggcgc

SEQ ID NO: 4203326 - RNA, 87 nt, Human adenovirus C
gggcgguaaccgcauggaucacggcggacggccggauccgggguucgaaccccggucguccgccaugauacccuugcgaauuuaucc

SEQ ID NO: 4203327 - RNA, 89 nt, Human adenovirus C
gguggauaaauucgcaaggguaucauggcggacgaccgggguucgaaccccggauccggccguccgccgugauccaugcgguuaccgcc

SEQ ID NO: 4203328 - RNA, 61 nt, Human adenovirus C
gugagugcgcccauggacauaaaguuacuggagaaugggaugcgccaaagggugcgaucgc

SEQ ID NO: 4203329 - RNA, 108 nt, Human adenovirus C
uuguugcagagcguuugccgcgcguuucucgucgcguccaagacccucaaagauuuuuggcacuucgucgagcgaggcgauaucagguaugacagcgcccugccgcaa

SEQ ID NO: 4203330 - RNA, 68 nt, Human adenovirus C
auccuacacgguguaagcuucuauggguuuaacaauaccuguguggaagccuggaccgauguaagggu

SEQ ID NO: 4203331 - RNA, 64 nt, Human adenovirus C
ccccgcggcgccgggcccggcacuaccuggacuuggaggagggcgagggccuggcgcggcuagg

SEQ ID NO: 4203332 - RNA, 82 nt, Human adenovirus C
cgggcgcaggguccucgucagcguagucugggucacggugaaggggugcgcuccgggcugcgcgcuggccagggugcgcuug

SEQ ID NO: 4203333 - RNA, 55 nt, Human adenovirus C
gaucaugucuaccugcggggcgaugaagaaaaccguuuccgggguaggggagauc

SEQ ID NO: 4203334 - RNA, 125 nt, Human adenovirus C
ccucuuucagcgccugcgaaacuacgccgucuucgcccggcacguggagcucaaucucgcgcagguggucaugcgcgcccgcgaugccgaagggggcguggucuacagccgcgucuggaacgagg

SEQ ID NO: 4203335 - RNA, 59 nt, Human adenovirus C
ccugguguaccaggaaagucccgcucccaccacugugguacuucccagagacgcccagg

SEQ ID NO: 4203336 - RNA, 91 nt, Human adenovirus C
gcaacaagcuuacauaggggcuacgcugguuagcauagcuccgaguaugcgugucauaaucaguguggguucuuuugucaugguuccuggc

SEQ ID NO: 4203337 - RNA, 76 nt, Human adenovirus C
gcaccacugcagagcuucaugcugcggggugguguuguagaugauccagucguagcaggagcgcugggcguggugc

SEQ ID NO: 4203338 - RNA, 74 nt, Human adenovirus C
gcccgguuccauguugcgcgcggucauguccagcgccacgcugggcguuaccccgucgcgcaucagguuaaggc

SEQ ID NO: 4203339 - RNA, 73 nt, Human adenovirus C
ggccucgcgguacagugucagcaagugaccuagguaugugucccgggacacgcugccacuguccgugaagggc

SEQ ID NO: 4203340 - RNA, 56 nt, Human adenovirus C
ugcaaaauuccaagguaggagaccagguugcagagcuccacguuggaaauuuugca

SEQ ID NO: 4203341 - RNA, 113 nt, Human adenovirus C
uugaugaaaagaaaaugccuugauuuuccgcuugcuuguauuccccuggacaauuuacucuaugugggauaugcuccaggcgggcaagauuauacccacaaccuucaaaucaa

SEQ ID NO: 4203342 - RNA, 56 nt, Human adenovirus D
acauguaacuuagucguagggcgccaucuugcccacguccaaaauggcuuacaugu

SEQ ID NO: 4203343 - RNA, 59 nt, Human adenovirus D
cagcgucugccucaggcgcucgggggaggacgaucucggccagguccgaggcgacggug

SEQ ID NO: 4203344 - RNA, 70 nt, Human adenovirus D
gcucgcgguugagggcguauuccucgucauccuuccaguacucccggagcgggaauccucgaucguccgc

SEQ ID NO: 4203345 - RNA, 55 nt, Human adenovirus D
gcugauuggccgagaaacguugaugcaaaugacgucacgacgcacggcuaacggu

SEQ ID NO: 4203346 - RNA, 78 nt, Human adenovirus D
ggcuaccugggaggagaggaggaugugcugcugaaacaccugcagcgccagucccucauccuccgggacgcccuggcc

SEQ ID NO: 4203347 - RNA, 95 nt, Human adenovirus D
gguaccuucgagcugcaagguccgcaggaguccaccgcuccgcugaaacucacgccgggguuguggacuuccgcguaccugcgcaaauuuguacc

SEQ ID NO: 4203348 - RNA, 56 nt, Human adenovirus D
ugagaggagugugauaugcacaguagucaucaaaugcgagcauacaugcccucuca

SEQ ID NO: 4203349 - RNA, 67 nt, Human adenovirus D
agguguaccagucgggcccggacuacuuuuuccaaacuagcagacagggccugcaaacggugaaccu

SEQ ID NO: 4203350 - RNA, 65 nt, Human adenovirus D
gcgucugcagcauugucugccuggucaucaccuuccugcagcucaucgacuggugcugcgcgcgc

SEQ ID NO: 4203351 - RNA, 116 nt, Human adenovirus D
agacacugcuccaauugaaggcgcccccguucagcuggcuggugccgaucucguuccaggugcccaugaacggccgcgugccgugccgcggagccagggacgcaaaauugaugucu

SEQ ID NO: 4203352 - RNA, 76 nt, Human adenovirus D
gcagauuuacagcuucgaguacgaggccaugcugcgccgaagcgccguggccucuucgcccgaccgcugucucagc

SEQ ID NO: 4203353 - RNA, 99 nt, Human adenovirus D
ggauguugauggcaucgaggagcuccuuggcggcacgcuccugcugcugacggacgcgcaguugcaggaugcgcugcucggaggccuggccguccaucu

SEQ ID NO: 4203354 - RNA, 72 nt, Human adenovirus D
ggcgucccggaggaugagggacuggcgcugcagguguuucagcagcacauccuccucuccucccagguagcc

SEQ ID NO: 4203355 - RNA, 105 nt, Human adenovirus D
guccgucaccagccgguccagguuggacugcacguuugugcuguuguagcggccuacgcgcuccagcagggcguuguacacuagcccggccucgucgggacggau

SEQ ID NO: 4203356 - RNA, 68 nt, Human adenovirus D
guggucaggaaguugcuguggucguuuugauaguucagggaagcgauguccgccgacuuguuguccac

SEQ ID NO: 4203357 - RNA, 59 nt, Human adenovirus D
ucacucccaggcccacaauacugugcagcgugcucugccaguucugggccuggcggcgg

SEQ ID NO: 4203358 - RNA, 86 nt, Human adenovirus D
ccaucuggaccaacuaaaguuacguuugacccacuagugacuguaauuaguuuugugucagguguguuuggcuuuaguuuagaugg

SEQ ID NO: 4203359 - RNA, 86 nt, Human adenovirus D
cgcggggccggaaccgccgcugccgccgggagcgcguccgcgacaccgcuucuaaaagcgcaccgcggcacggucguggccccgcg

SEQ ID NO: 4203360 - RNA, 59 nt, Human adenovirus D
gcguggugggcaugccggccuucacggccuccucguacgaaggcggcucguccaccugc

SEQ ID NO: 4203361 - RNA, 55 nt, Human adenovirus D
ggagggcauaucaauuuucuccugauagcagucuaagaaauuccauauguccgcc

SEQ ID NO: 4203362 - RNA, 71 nt, Human adenovirus D
uugagcuuaccuugcgacugcgauuggcuagacgcuuuccucgaaagauucuccgauccggucgaucucga

SEQ ID NO: 4203363 - RNA, 62 nt, Human adenovirus E
gaggacgacggucuggcggcggcugcuucuuccaccuccuccucugccuccuccucgucuuc

SEQ ID NO: 4203364 - RNA, 58 nt, Human adenovirus E
ggagaucuugcaggccuggcgcacgaacccgugccugaagagguagugcagguucucc

SEQ ID NO: 4203365 - RNA, 60 nt, Human adenovirus E
ccgugggcaucaugcugagggagucccuggacccggacccccugagcagcagcuugacgg

SEQ ID NO: 4203366 - RNA, 55 nt, Human adenovirus E
cgcuggcuccuggaccuggugaacauucugcagagcaucguggugcaggagcgcg

SEQ ID NO: 4203367 - RNA, 60 nt, Human adenovirus E
gguuguaccugguggacaacaagucggcggacaucgccucgcugaacuaccagaacgacc

SEQ ID NO: 4203368 - RNA, 62 nt, Human adenovirus E
ucccgaggaaucgagguccacccccucucccagcuugagggugauuuccccguucuuggugg

SEQ ID NO: 4203369 - RNA, 59 nt, Human adenovirus E
uuucaguauguggaaucaggcgguggacagcuaugauccugaugugcgcauuauugaaa

SEQ ID NO: 4203370 - RNA, 72 nt, Human adenovirus E
gaugcucugcagaauguucaccagguccaggagccagcggcccucgggcucggugauauucagcagcgccuc

SEQ ID NO: 4203371 - RNA, 61 nt, Human adenovirus E
ggcccgcgucugcuccugcagcugagccaccugcugggucagcucgcccaggcgcuggguc

SEQ ID NO: 4203372 - RNA, 94 nt, Human adenovirus E
guucgugcgccaggccugcaagaucuccaacguggagcugaccaaccuggucucguacaugggcaucuugcacgagaaccgccuggggcagaac

SEQ ID NO: 4203373 - RNA, 69 nt, Human adenovirus E
ucuugcugcccggcugcgggguggacuucaccgagagccgccucagcaaccugcugggcauucgcaaga

SEQ ID NO: 4203374 - RNA, 58 nt, Human adenovirus F
ugcagagccaccggaggcuggcggcuauuuuccagccgcugauugauuugguuuugca

SEQ ID NO: 4203375 - RNA, 97 nt, Human adenovirus F
uuccaaagcuguuacaucagugguucuuaauccgcaggcagagcccuugguuuccgccugggagaaaggcauggauuuaaugauaaagcuaauggaa

SEQ ID NO: 4203376 - RNA, 80 nt, Human adenovirus F
gcucaaugaggcuuggcagucucuaccuaugcaacagaugauaagaugcacaguuagcgcccugucgcugccucaggggc

SEQ ID NO: 4203377 - RNA, 58 nt, Human adenovirus F
ggagaucuugcaggccugacgaacguagccaugacggaaggcauagugcagggacucc

SEQ ID NO: 4203378 - RNA, 69 nt, Human adenovirus F
ggcucccauccacguguagguuucgacgucguaggugacaaagaggcguucgacgcgaggaugagagcc

SEQ ID NO: 4203379 - RNA, 72 nt, Human adenovirus F
guaacguaugcuguuccgcccuuccguaggccccagguaacggggagggacguggagcgccugcagcguugc

SEQ ID NO: 4203380 - RNA, 64 nt, Human adenovirus F
uauugcggagccugagggucgcuggcuuuuggaccugguuaauauccuucagagcauuguggua

SEQ ID NO: 4203381 - RNA, 64 nt, Human adenovirus F
agcccaccuguaccgggucuuggaaaacauccauaaaguuuuaaacgaccgcgacagguggucu

SEQ ID NO: 4203382 - RNA, 70 nt, Human adenovirus F
ccuagaccaccugucgcggucguuuaaaacuuuauggauguuuuccaagacccgguacaggugggcuugg

SEQ ID NO: 4203383 - RNA, 73 nt, Human adenovirus F
gcaagcccauucugccaguuggggauuggcggcuagaaaaccgcgccauagcuggagggcaaaaugggcuugc

SEQ ID NO: 4203384 - RNA, 105 nt, Human adenovirus F
gccgugauugguaauuuggaaaaucgcaucuuuuuugacuuggcuguaauuuuucaccaacgcagcgguggggagaggugugaucuucgugacuugcacuuuggc

SEQ ID NO: 4203385 - RNA, 57 nt, Human adenovirus F
gucaaaauugauggucuggguaccggccucugucgggguaaagucauuauuuuguac

SEQ ID NO: 4203386 - RNA, 60 nt, Human adenovirus F
gccucugccaguguuaauacuaagcugguuguugcuuacugucaguggugcggcgguggc

SEQ ID NO: 4203387 - RNA, 57 nt, Human adenovirus F
gucgcccucuucugcaccugcacgcucuugcuguggguggaugauggagggaacgac

SEQ ID NO: 4203388 - RNA, 115 nt, Human adenovirus F
uggcaugcccaaggaaguguuauuuauggggagcguguuugucagagguaggcauuuuauauauauucgccugcuguaugaugggcacgcggcuauaguguuggagcgcaugucg

SEQ ID NO: 4203389 - RNA, 61 nt, Human adenovirus F
uugucguucccuccaucauccacccacagcaagagcgugcaggugcagaagagggcgacga

SEQ ID NO: 4203390 - RNA, 55 nt, Human astrovirus
cacuggguacacuggaggugcugucauaauagacccagcagacuuccauccagug

SEQ ID NO: 4203391 - RNA, 84 nt, Human coronavirus 229E
agccaaucuaccaguaaucagccuaucuacuuguugaucagccugaauagugucaagucugucauagauagccugaauagagcu

SEQ ID NO: 4203392 - RNA, 71 nt, Human coronavirus 229E
guuuuguuuguuaaugacaaaauuacugaauuccaauuggauuacaguauugaugucauugauaaugaaau

SEQ ID NO: 4203393 - RNA, 73 nt, Human coronavirus 229E
uguagguucuagcuuugaugguguuauguauggugguuuugaagaccaaccuaaucuucaaguugaaucugca

SEQ ID NO: 4203394 - RNA, 56 nt, Human coronavirus 229E
aggguauucguugugcuguaacugaugccaagugguauuguuaugacaagaacccu

SEQ ID NO: 4203395 - RNA, 130 nt, Human coronavirus 229E
aguuaugacuacguuaguuugcugguuaugcuacuuugugcaauuucuaaugaaugguauauuggugcuauuauuuuuagaauuugucguuuugguguugcauuuuuaccaguggaauacgugucuuacu

SEQ ID NO: 4203396 - RNA, 87 nt, Human coronavirus 229E
gguggcgucucuuuauuagcuacuaugacuacaagacaguuucaucagaaaugucugaaauccauaguagcuaccagaaaugccacc

SEQ ID NO: 4203397 - RNA, 81 nt, Human coronavirus 229E
uggcaagaaaauuaaacaugaaggugacugggauagcuuuuguaagacuauucaaucagcacuuucuguuguuucuugcua

SEQ ID NO: 4203398 - RNA, 84 nt, Human coronavirus 229E
uuaaugaaaaccaagcugucacgcaaauaccugcaacuagcauuguugcuaagcaaggugcuggugaugcuggccauucauuaa

SEQ ID NO: 4203399 - RNA, 85 nt, Human coronavirus 229E
uugcaaugucacauuuguuaacauuucucgcucugaguugcaaaccauugugccagaguauauugauguuaauaagacgcugcaa

SEQ ID NO: 4203400 - RNA, 80 nt, Human coronavirus 229E
aagcuuacgcuaugcauggauuuggugugcugcauauuuaauugcguauauuucuuuugcuccauggugguugugugcuu

SEQ ID NO: 4203401 - RNA, 114 nt, Human coronavirus 229E
caucaauuuuucguggugcugugucuuguggucauuaccagacuaacaucuauucacaaaauuuguguguggaugguuuugguguuaacaagauucagcccuggacaaaugaug

SEQ ID NO: 4203402 - RNA, 97 nt, Human coronavirus 229E
ccauuuugcaaaguguugcaucuucuuuuguugguaugccaucuuuuguugcauaugaaacagcaagacaagaguaugaaaaugcuguugcaaaugg

SEQ ID NO: 4203403 - RNA, 81 nt, Human coronavirus 229E
guggcuggucgcagugccauagaagacauacuuuuuagcaaacuuguuacuucuggacuuggcacuguggacgcagacuac

SEQ ID NO: 4203404 - RNA, 66 nt, Human coronavirus 229E
accagauguuaacaguuaaugugguugcauuucuuuaugcugcuauauugaaugguugcacauggu

SEQ ID NO: 4203405 - RNA, 79 nt, Human coronavirus 229E
cguuauuuuguuaagauuggagcuguuaaacauugccaaugugguacuguugcaacaugcuacaauucuguuaguaaug

SEQ ID NO: 4203406 - RNA, 64 nt, Human coronavirus 229E
gcagaggauguuuguacuuguuacgauaauaguauacaagguucauacgaacguuuuacucugu

SEQ ID NO: 4203407 - RNA, 83 nt, Human coronavirus 229E
gcaugagggcagaaccauuuaugguaauguuaguagacaggaucuuacuaaauacaccaugauggauuugugcuucgcucugc

SEQ ID NO: 4203408 - RNA, 61 nt, Human coronavirus 229E
gcuuuaacaccauuggccacaacaccugcacuuccaaaguuguggucaaggucucuggggc

SEQ ID NO: 4203409 - RNA, 100 nt, Human coronavirus 229E
ugcuuacaugccaauugcagacccuacacauuuugacauugaagaaguugaacuuuuagaugcagaguuuguagaaccaggcuguggugguauuuuggca

SEQ ID NO: 4203410 - RNA, 81 nt, Human coronavirus 229E
uucuacuugugcuuuuucaugcccuauuuuauguacgauaucgugaguaguuuugaggguuaugauuuuaaguauauagaa

SEQ ID NO: 4203411 - RNA, 62 nt, Human coronavirus 229E
uguaugagaagucuacaguauuacaagcugcuggucuuuguguaguaugugguucucaaaca

SEQ ID NO: 4203412 - RNA, 62 nt, Human coronavirus 229E
uuugaacaguguaauuaagcuccgcagauuuauuuucaagggugcuaauuucacuggucaaa

SEQ ID NO: 4203413 - RNA, 93 nt, Human echovirus 1
caugguguuauugguauagugaccaugggaggugaaggugucguugguuucgccgaugugcgagaccuucuauggcuagaggaugacgccaug

SEQ ID NO: 4203414 - RNA, 71 nt, Human echovirus 1
gaggcuuauagagucgaauugagcaccaacacuaaugccgggacucaaguguuuggcuuucaacugaaccc

SEQ ID NO: 4203415 - RNA, 89 nt, Human echovirus 1
guguucauggucgguaguccuugguguccagcuagucguaguccauuguacucggcacacaugggggccacugucaccguuaugggcac

SEQ ID NO: 4203416 - RNA, 78 nt, Human herpesvirus 1
agagcgacccgucccgggccuucgcggccacggccaacccgugggcgucgcagcgauuuucguacggggaccugcucu

SEQ ID NO: 4203417 - RNA, 66 nt, Human herpesvirus 1
agccccacgcagggucugcgagcaauaccugcccggggaaagcuacgccuaccucugccugggguu

SEQ ID NO: 4203418 - RNA, 65 nt, Human herpesvirus 1
agcgcgccacggccuccgcguucucgggcgugaguuccagggggacgggguaggccgugcccguu

SEQ ID NO: 4203419 - RNA, 56 nt, Human herpesvirus 1
cacccggagguuccggaggcgccgcgcggacggcgcggggcccccgcuuccggaug

SEQ ID NO: 4203420 - RNA, 79 nt, Human herpesvirus 1
cagccucggcccccugggccagacgaccgcgguuccggacuccguggaucugucucgccaggggcuggccguuacgcug

SEQ ID NO: 4203421 - RNA, 65 nt, Human herpesvirus 1
ccagcggccggccggcgcuuagggggaggaugucgccgacgccccuuggccgccccggcugcagg

SEQ ID NO: 4203422 - RNA, 89 nt, Human herpesvirus 1
cccagcuucaggcaggccgugugcaggcccugcaugccgauucccauggaccgcagguugucguugccgcgggugcacuggggcguggg

SEQ ID NO: 4203423 - RNA, 57 nt, Human herpesvirus 1
cccgcgcgucgacgggacccagguauccccccugccgggccugcggaggaccgcggg

SEQ ID NO: 4203424 - RNA, 67 nt, Human herpesvirus 1
ccgcgccgacucuggccucacccgcgaggagguacgugccguacguggguuccgggagcaggcgugg

SEQ ID NO: 4203425 - RNA, 82 nt, Human herpesvirus 1
ccguaugguguugcgcaggugcaugccccagguuccgccggacaccugcagcaaacggcaccacgugcgcggggccagacgg

SEQ ID NO: 4203426 - RNA, 77 nt, Human herpesvirus 1
ccugaucauacugcgccgcggcggcgucgcguccggugcgggggcuggcguuguugauggccacggugagagccagg

SEQ ID NO: 4203427 - RNA, 76 nt, Human herpesvirus 1
cgcguaucggcgucccggcgcggcgagcgucugacggucugucucuggcggucccgcgucgggucguggauccgug

SEQ ID NO: 4203428 - RNA, 69 nt, Human herpesvirus 1
cggcgcuguggccucccguuccgggcccccguguaaagguuggucaggugaggccacagcggcaccccg

SEQ ID NO: 4203429 - RNA, 75 nt, Human herpesvirus 1
cgucucuccggagagcggcuuggugcggagcucccgggagcuccgcggaagacccaggccgccucggguguaacg

SEQ ID NO: 4203430 - RNA, 73 nt, Human herpesvirus 1
cgugucgauggccgucuuugacgagccgcccaccgacaucuccgcguggccgcuguucgagggccaggacacg

SEQ ID NO: 4203431 - RNA, 64 nt, Human herpesvirus 1
cucgucgagcguaccgacgggcggcacaccuaucacgugacuggccgucaggagcucggcgcag

SEQ ID NO: 4203432 - RNA, 77 nt, Human herpesvirus 1
cugucgguggcccagacgccguacccggugagggucgcguugaugauauacugggcguggugauggacgaucgacag

SEQ ID NO: 4203433 - RNA, 81 nt, Human herpesvirus 1
gaagagggaagaagaggggucgggauccaaaggacggacccagaccaccuuugguugcagaccccuuucuccccccucuuc

SEQ ID NO: 4203434 - RNA, 81 nt, Human herpesvirus 1
gaagaggggggagaaaggggucugcaaccaaagguggucuggguccguccuuuggaucccgaccccucuucuucccucuuc

SEQ ID NO: 4203435 - RNA, 77 nt, Human herpesvirus 1
gaggggggagaaaggggucugcaaccaaagguggucuggguccguccuuuggaucccgaccccucuucuucccucuu

SEQ ID NO: 4203436 - RNA, 56 nt, Human herpesvirus 1
gccacggcggccgccgcgugcgccaggccccagccgaagcggccggccgccauggc

SEQ ID NO: 4203437 - RNA, 74 nt, Human herpesvirus 1
gcggagcgggcuggggcucgaggucgcucgguggggcgcgacgccgcagaacgcccucgagucgccguggccgc

SEQ ID NO: 4203438 - RNA, 70 nt, Human herpesvirus 1
ggacgucgaugccuuucaaaccgaccagucgaugggugaaaucgaccgggucucgagguaucgguucgcc

SEQ ID NO: 4203439 - RNA, 127 nt, Human herpesvirus 1
ggcgccggaggucgcgucggcguccagcucgacccgccggggcugcccggccgugaagcggcccguggcgucgcggccggccaccgccgcgcgggcccggcggcgcucgaugcggcccgcggaggcc

SEQ ID NO: 4203440 - RNA, 95 nt, Human herpesvirus 1
ggcgcgggcgccaagcgggccaccgucagcgaguucgugcaagucaaacacauugaccgcgugggccccgcuggcguuucgccggcgccuccgcc

SEQ ID NO: 4203441 - RNA, 129 nt, Human herpesvirus 1
ggcucacaaaccggcccccguccccgggcugcgucucggggucagccucgagcuggucgacgacggguacgauacagucgaagaggcucguguuguuuuccgaguagcggaccacggaggcccggaguc

SEQ ID NO: 4203442 - RNA, 70 nt, Human herpesvirus 1
ggcucauggccacggcggccgccgcgugcgccaggccccagccgaagcggccggccgccauggcguagcc

SEQ ID NO: 4203443 - RNA, 79 nt, Human herpesvirus 1
gggguguuccggacucaaccgccgaacccaggaacccgccgcuccugguguuuacgaacgaguuugacgcggaggcccc

SEQ ID NO: 4203444 - RNA, 69 nt, Human herpesvirus 1
gggucgcucgguauucgaggccacacgcgucaccuuaauaugcgaaguggaccugggaccgcgccgccc

SEQ ID NO: 4203445 - RNA, 61 nt, Human herpesvirus 1
ggucgaugcggcccgaggauugccggcaaaagugcgauagaggcucgggccgugggcgacc

SEQ ID NO: 4203446 - RNA, 81 nt, Human herpesvirus 1
guaaagcggcagccuucgcucuccauccugcaucagggccggggcuucggggugaaugagcugggcggccucccgcgugac

SEQ ID NO: 4203447 - RNA, 67 nt, Human herpesvirus 1
guacugcaccucgcugcgaaccagcccgggugugcuaauauccgggcugcgcgugcgggcgcaggac

SEQ ID NO: 4203448 - RNA, 115 nt, Human herpesvirus 1
guccguccagauucugcgggcauaggauaccauaauuuuauuggugggucguuuguucggggacaagcgcgcucgucugacguuugggcuacucgucccagaauuuggccaggac

SEQ ID NO: 4203449 - RNA, 55 nt, Human herpesvirus 1
gugucgcgugucgcgcaugcgcauaaaaaauuugguguggugccgccugugauac

SEQ ID NO: 4203450 - RNA, 86 nt, Human herpesvirus 1
guuguaggguuguuuccggacgucuucggaggccccgcggacaaucuggggggccuccgacggugcguuuaggagcacgcugcggc

SEQ ID NO: 4203451 - RNA, 59 nt, Human herpesvirus 1
uagcauaucacauaccccguuccgcuuccgcggggacccgggcggggguggauacgcug

SEQ ID NO: 4203452 - RNA, 76 nt, Human herpesvirus 1
uccucgugcccgggacccacguggcggccaacccacagguggaccgcgagggacacguggugcccggguucgaggg

SEQ ID NO: 4203453 - RNA, 63 nt, Human herpesvirus 1
ucggugcucuccaaggggcuguccuccgcaaacaggcccguggugguguuuggggggcagcga

SEQ ID NO: 4203454 - RNA, 84 nt, Human herpesvirus 1
ugagucaguggggaccacgcccccaacacggcgaccccgguccuuguguguuuguugugggggcgugucucuguguaugaguca

SEQ ID NO: 4203455 - RNA, 78 nt, Human herpesvirus 1
guggguguguaggcgaugcgggucccccgaguccgcgggaagggcguggguuuggcgcgcguaugcguauucgccaac

SEQ ID NO: 4203456 - RNA, 67 nt, Human herpesvirus 1
uccggucccgccgaacgcauacaugcccuauuaucucagggaguaugugacgcggcuggucaacggg

SEQ ID NO: 4203457 - RNA, 57 nt, Human herpesvirus 1
ucgucgucagcaccgucauccacaccuuaucguuuuuguguauuggugcgauggcga

SEQ ID NO: 4203458 - RNA, 56 nt, Human herpesvirus 1
ucuucgggggugccgacgcaggcgucgguaauggccgacgcaggcgcccccggcga

SEQ ID NO: 4203459 - RNA, 90 nt, Human herpesvirus 1
uguuuccgcccuugccgaauccagggaggguaccgucgacggccggggcgucuaucaggugccccccggccucgucgagguaggaacgca

SEQ ID NO: 4203460 - RNA, 79 nt, Human herpesvirus 1
aaacgcgggcguauuggucccaauggggucucggugggguaucgacagagugccagcccugggaccgaaccccgcguuu

SEQ ID NO: 4203461 - RNA, 68 nt, Human herpesvirus 1
agcgccccgacggccaggugcgugacugugguccgcgcgccaauggggucgggaaaaacuaccgcgcu

SEQ ID NO: 4203462 - RNA, 62 nt, Human herpesvirus 1
caucgggccagauucacgcuucccagguugcagaccccacuggaucgcuuggaggccggaug

SEQ ID NO: 4203463 - RNA, 72 nt, Human herpesvirus 1
cccaacgaucccacgggccgccggccgaugaggucgcaccggccagggucgcgcggcccgaaaacgucuggg

SEQ ID NO: 4203464 - RNA, 55 nt, Human herpesvirus 1
ccccgagccacgccagaaccuuggcaaaggucgacgggguggcguggcuucgggg

SEQ ID NO: 4203465 - RNA, 79 nt, Human herpesvirus 1
ccccgaugauggucccgacgccaacccaggccgcggcggggagccgagcccgcauggggggugucccggggcccagggg

SEQ ID NO: 4203466 - RNA, 62 nt, Human herpesvirus 1
ccccugcggcguugcgacauacaaaauacaccagggcguggaaguacucgcgagcgcggggg

SEQ ID NO: 4203467 - RNA, 80 nt, Human herpesvirus 1
cccggcggacaugcugggccuaccguggacuccauuuccgagacgacguggggggagcggugguugagcgcgccgccggg

SEQ ID NO: 4203468 - RNA, 58 nt, Human herpesvirus 1
ccgggcaugaaaacgaccuccacacggaccaccggaugggggugugcguucgaugcgg

SEQ ID NO: 4203469 - RNA, 84 nt, Human herpesvirus 1
ccgggggaugguaaggcgucgcggcguccuggaucgacgguaugugccaguuuggugggauuugcggcgccaccguccccacgg

SEQ ID NO: 4203470 - RNA, 63 nt, Human herpesvirus 1
ccguccgccuucuccgugacauacagggucauggauuggcuauggucgacguagggggcgcgg

SEQ ID NO: 4203471 - RNA, 69 nt, Human herpesvirus 1
cggacgucgaugccuuucaaaccgaccagucgaugggugaaaucgaccgggucucgagguaucgguucg

SEQ ID NO: 4203472 - RNA, 68 nt, Human herpesvirus 1
cggaguugacaaugcgcgcgauagagucgacguccguccccaggucgucgacucuaucgcgcgugccg

SEQ ID NO: 4203473 - RNA, 82 nt, Human herpesvirus 1
cucgcgggcccacgagccgcggcgcgccaggcgggcggccgaggcccagaccaccagguggcgcacccggacguggggcgag

SEQ ID NO: 4203474 - RNA, 60 nt, Human herpesvirus 1
gacgccccgcgcccccccacgcagaggcgccgccgcgccccccgugacgggcggggcguc

SEQ ID NO: 4203475 - RNA, 57 nt, Human herpesvirus 1
gagcuuguuuucgugggggacgaggaggacgucuccaagcuuuccgagggcgagcuc

SEQ ID NO: 4203476 - RNA, 57 nt, Human herpesvirus 1
gaguuagacaggcaagcacuacucgccucugcacgcacaugcuugccugucaaacuc

SEQ ID NO: 4203477 - RNA, 91 nt, Human herpesvirus 1
gauggcccuccaggcugucgacgcccccucccuguuugucgccuggcuggccgcucgguggcuccggggggcuuccggccugggggccguc

SEQ ID NO: 4203478 - RNA, 83 nt, Human herpesvirus 1
gcagacagacccaugguuuuuggauggccugggcauggaccgcauguacuggcgcgacacgaacaccgggcgucuguggcugc

SEQ ID NO: 4203479 - RNA, 65 nt, Human herpesvirus 1
gcccccccgcgcauggugccccgcaggaucuuguccagggccuguucgguaucgucguugggggu

SEQ ID NO: 4203480 - RNA, 59 nt, Human herpesvirus 1
gccccgccgcuugaucauuaucaccccguugcggggguccggagaucaugcgcgggugu

SEQ ID NO: 4203481 - RNA, 70 nt, Human herpesvirus 1
gcccgggcaaguaugccccccuggcgagcccagaccccuucuccccacaacauggagcauacgcucgggc

SEQ ID NO: 4203482 - RNA, 89 nt, Human herpesvirus 1
gccgugugccccagucgcacucgucccuggcucaggccgcgaaccaagaacagagucugugccgggcgcgugcgacgguggcgcgcggc

SEQ ID NO: 4203483 - RNA, 66 nt, Human herpesvirus 1
gcgcgauggcggcgucgagaccggugucguaggugacgauagugccgaggcgccgcccgaucgcgc

SEQ ID NO: 4203484 - RNA, 64 nt, Human herpesvirus 1
gcgcgugguccccggggacguggcgcuggaccaggccugcuuccggaucucgggcgccgcgcgc

SEQ ID NO: 4203485 - RNA, 60 nt, Human herpesvirus 1
gcgggccugucguguagauucgaaaccacggacgggugauugugucgcagggcggcccgc

SEQ ID NO: 4203486 - RNA, 59 nt, Human herpesvirus 1
ggcagggcguuguucuggucaaggagggucauuacguugacgacaacaacgcccauguu

SEQ ID NO: 4203487 - RNA, 85 nt, Human herpesvirus 1
ggccgaggcccagaccaccagguggcgcacccggacguggggcgagaagcgcacccgcgcgggggucgcgggggucgcggggguc

SEQ ID NO: 4203488 - RNA, 69 nt, Human herpesvirus 1
ggccgccggggcgcccgaggccucgaaccggcgucgcgccuccuccgccucgggcgccccccagaggcc

SEQ ID NO: 4203489 - RNA, 60 nt, Human herpesvirus 1
gggcccagcgcgaucuacgggagcugcggugccgggaucccgaggcgucgcugccggccc

SEQ ID NO: 4203490 - RNA, 81 nt, Human herpesvirus 1
gggcccgccaugcucacgcugcaggugcuggcccacaacauggccgaacgcacaacggcgcugcucugcucggcggcgccc

SEQ ID NO: 4203491 - RNA, 99 nt, Human herpesvirus 1
ggggcgggcggcgccggaguggcagggcccccguucgccgccugggucgcggccgcgaccccaggcgugccgggggaacucggagccgccgacgccacc

SEQ ID NO: 4203492 - RNA, 77 nt, Human herpesvirus 1
ggugucguuguuggugccgguggggcguaccgcguaaauacaucggugcagcggacuggcaccgaagacgguguacc

SEQ ID NO: 4203493 - RNA, 106 nt, Human herpesvirus 1
guaguuggugaucagguacaacaggcgcuccucccgggagagcggcggcccgcggcgcucgaaaaucgcagcgcuggcggccgucucgaggacgcgcuccagcugc

SEQ ID NO: 4203494 - RNA, 67 nt, Human herpesvirus 1
guccugcgcccgcacgcgcagcccggauauuagcacacccgggcugguucgcagcgaggugcaguac

SEQ ID NO: 4203495 - RNA, 101 nt, Human herpesvirus 1
guggccggggaccuggccccaugggcgguggaggaguuccggggcgcgcgggagcucauccaacgccgcaugggcuuauauagcgcguacgccaaggccac

SEQ ID NO: 4203496 - RNA, 73 nt, Human herpesvirus 1
ggggcuccggcgucgccugcacaggaaggaccccggggacggggcccgguuggcggcgacgcuucggggccuc

SEQ ID NO: 4203497 - RNA, 77 nt, Human herpesvirus 1
ggggggcguggggaaucgcguagguggcgcagauguccuugauggccugcaggucguacguggcccccgcgcccccc

SEQ ID NO: 4203498 - RNA, 72 nt, Human herpesvirus 1
ggggugccgcuguggccucaccugaccaaccuuuacacgggggcccggaacgggaggccacagcgccgucuu

SEQ ID NO: 4203499 - RNA, 79 nt, Human herpesvirus 1
ggggugccgcuguggccucaccugaccaaccuuuacacgggggcccggaacgggaggccacagcgccgucuuucucccc

SEQ ID NO: 4203500 - RNA, 70 nt, Human herpesvirus 1
gcccggcucgcgccgugcugacaaacgccuugcuguugggcgucuuccugugcacggccgacgccgcggu

SEQ ID NO: 4203501 - RNA, 99 nt, Human herpesvirus 1
gcgccuuuuccagcagcacgugcagcaucuggucggccgugccgcgcucaaacgccccgaggacggccuggacguugcgagcgagcuguuggauggcgc

SEQ ID NO: 4203502 - RNA, 109 nt, Human herpesvirus 1
gcggggucccgccguccccccagcgugcaggcugcggccgcgugguccgcgcagggcggggcgggccuggaggccggggcccgcgcgcugauggacgccguggacgcgc

SEQ ID NO: 4203503 - RNA, 66 nt, Human herpesvirus 1
ggagcugugccgccagacacgcguuuucgaucggguucaggucggcgugcaggaggcggacggccc

SEQ ID NO: 4203504 - RNA, 92 nt, Human herpesvirus 1
ggcgcgcgaaaucgguaaccggggcgaccgugucggggagggcaggcggccgccaacccuggguggucgcggaagccuggguggcgcgcgcc

SEQ ID NO: 4203505 - RNA, 76 nt, Human herpesvirus 1
ggcggacguggugccucagcguaacgccuacuauagcguucugaauacguuucaggcccuccaccgcuccgaagcc

SEQ ID NO: 4203506 - RNA, 77 nt, Human herpesvirus 1
ggcugcuccgugcuggccgcgggguuggggucgugggucgucacggcccgaagaugcguggcuaggcgcggggggcu

SEQ ID NO: 4203507 - RNA, 67 nt, Human herpesvirus 1
gggagugagggucgcgucgucuaugcgcuggaggugcgccgagaacagcgucacccgauuacucacc

SEQ ID NO: 4203508 - RNA, 59 nt, Human herpesvirus 1
gggggcggagcguugugugggcggggcguuugcuacgcucacgcgcaugcccgccacuc

SEQ ID NO: 4203509 - RNA, 57 nt, Human herpesvirus 1
ggguggcagcagcgccgggucucgcauuaggugauucagcucggcuugcgccugccc

SEQ ID NO: 4203510 - RNA, 88 nt, Human herpesvirus 1
ggugggcgcggacgaggcgucggcgggccucaccaugggcggcgaugcccuacgagugcccuuuuuagauuucgcgaccgcgaccccc

SEQ ID NO: 4203511 - RNA, 59 nt, Human herpesvirus 1
gucucguccguccggcaucuucggggcccaugaaccgaaacgcgagcugcacgcggggc

SEQ ID NO: 4203512 - RNA, 59 nt, Human herpesvirus 1
guucggacggcaggcacacguaacgcacgcuagggugugugcgucgcccgcgucuggac

SEQ ID NO: 4203513 - RNA, 105 nt, Human herpesvirus 1
uccgccacccugcgggcgacccggggggugcucugauagucucgcgugcccaaggcccgugaucgggguacuucgccgccgcgacccgccacccggugugcgcga

SEQ ID NO: 4203514 - RNA, 55 nt, Human herpesvirus 1
ucgaugugggggugaccuccgggcuggcggcugacccgggggaccccgauguggg

SEQ ID NO: 4203515 - RNA, 80 nt, Human herpesvirus 1
ugcugccgcccaccgauccccugcgcacacgggcccuggggauagccugcgcggccggggccucgauguggguggcggcg

SEQ ID NO: 4203516 - RNA, 77 nt, Human herpesvirus 1
acccagcuguuucccggccuggccgcccugugucuugacgcccaggcggggcggccggucgggucgacgcggcgggu

SEQ ID NO: 4203517 - RNA, 88 nt, Human herpesvirus 1
acgaccgggguggucagcacgcggcccccuagaaacucggcauacagggcgucgaugagaugggcugcgcugggcgccacugcgucgu

SEQ ID NO: 4203518 - RNA, 65 nt, Human herpesvirus 1
aucgccugggcggggcugguuuuuguucgacgauccgucaggucaagaaucccaucgcccgugau

SEQ ID NO: 4203519 - RNA, 65 nt, Human herpesvirus 1
ccgcaccgucccccgacgaccucuugcagacgguccgugaugcaaggacggcggggggccugcag

SEQ ID NO: 4203520 - RNA, 67 nt, Human herpesvirus 1
ccggccucuggcgucggcgcgugugggucuaccgcugagggaccaccggcgucggcgcccgggccgg

SEQ ID NO: 4203521 - RNA, 83 nt, Human herpesvirus 1
cggucucgacgccgccaucgcgcccuuucgccaccugucgccggcgucucgcgagggggcgcggcgacuggccgccgaggccg

SEQ ID NO: 4203522 - RNA, 68 nt, Human herpesvirus 1
cgugacgacagcuuuguaaagacucagggggagacuucgguggaguuugccuacagguuccugucgcg

SEQ ID NO: 4203523 - RNA, 69 nt, Human herpesvirus 1
cgugccugcugcgccuggccgaccagaagggcuuuauucugccggacacccaggggcgauuuaggggcg

SEQ ID NO: 4203524 - RNA, 66 nt, Human herpesvirus 1
cuccccugcggcguugcgacauacaaaauacaccagggcguggaaguacucgcgagcgcggggggg

SEQ ID NO: 4203525 - RNA, 81 nt, Human herpesvirus 1
gccggggugguagaguuugacaggcaagcaugugcgugcagaggcgaguagugcuugccugucuaacucgcuagucucggc

SEQ ID NO: 4203526 - RNA, 71 nt, Human herpesvirus 1
gccucggccacgggccgcagcggcaccgugcuggcggcggcgggggccguggaggugcugggggcggaggc

SEQ ID NO: 4203527 - RNA, 64 nt, Human herpesvirus 1
gcgaagcguucgcacuucgucccaauauauauauauuauuagggcgaagugcgagcacuggcgc

SEQ ID NO: 4203528 - RNA, 87 nt, Human herpesvirus 1
gcgccuugcguggggcucgggggcgagcugugcccgcgugauucuguuuaguuacgacgagcucgucccccccaacacgcgcuacgc

SEQ ID NO: 4203529 - RNA, 88 nt, Human herpesvirus 1
gcgugccggggugguagaguuugacaggcaagcaugugcgugcagaggcgaguagugcuugccugucuaacucgcuagucucggccgc

SEQ ID NO: 4203530 - RNA, 67 nt, Human herpesvirus 1
gcucucggcgggggccgucuggccggccguuaggcugggggcgcagauagccgcccccuccgagagc

SEQ ID NO: 4203531 - RNA, 78 nt, Human herpesvirus 1
gcuuugucuccauguccuuuugucaaucgguccgcgaacggagguaaucccggcacgacgacggacgcccgacaaggu

SEQ ID NO: 4203532 - RNA, 88 nt, Human herpesvirus 1
ggagucgggcacggcgccagugcucgcacuucgcccuaauaauauauauauauugggacgaagugcgaacgcuucgcguucucacuuc

SEQ ID NO: 4203533 - RNA, 60 nt, Human herpesvirus 1
ggcacgcgcgauagagucgacgaccuggggacggacgucgacucuaucgcgcgcauuguc

SEQ ID NO: 4203534 - RNA, 69 nt, Human herpesvirus 1
ggccagguccugucgggucacgaaugcgacguagugcgcguacgccguguccuucacggggcucugguc

SEQ ID NO: 4203535 - RNA, 94 nt, Human herpesvirus 1
gggacucugcgcgcuuccauaauacgcccugcgguacgcggcaagcacgcgcaccucgugguggacguauagcgugguaaggccgcguuguccc

SEQ ID NO: 4203536 - RNA, 82 nt, Human herpesvirus 1
gggcgaugucgagauccaggaugauguuugugauugccagcgcgccguugaauaucucguugcgauucacguacaucugccc

SEQ ID NO: 4203537 - RNA, 130 nt, Human herpesvirus 1
gggcguggccgcuauuauaaaaaaagugagaacgcgaagcguucgcacuuuguccuaauaauauauauauuauuaggacaaagugcgaacgcuucgcguucucacuuuuuuuauaauagcggccacgccc

SEQ ID NO: 4203538 - RNA, 129 nt, Human herpesvirus 1
gggcugaucgccugcgugcagcuggagcgcguccucgagacggccgccagcgcugcgauuuucgagcgccgcgggccgccgcucucccgggaggagcgccuguuguaccugaucaccaacuaccugccc

SEQ ID NO: 4203539 - RNA, 129 nt, Human herpesvirus 1
guccaccuccugccacuuggucauggugcagaccgacgggcgcuuuggcacccagucccaggccacggugaacuugggggucgugagcagguuccggguggucggcgccguggcccgggccuugguggu

SEQ ID NO: 4203540 - RNA, 68 nt, Human herpesvirus 1
gugguccagcugcucgagucccugccugucuucgaccagcacacgcgggacaucgcgcagcgcgccgc

SEQ ID NO: 4203541 - RNA, 55 nt, Human herpesvirus 1
gugugcacggaugagaucgcgccccaccugcgcugcgacaccuucccgugcaugc

SEQ ID NO: 4203542 - RNA, 77 nt, Human herpesvirus 1
ucggccgcgucguugccgucgucguccucguccucgucggacgacgaggacgaagaggaugcggacgacgaggacga

SEQ ID NO: 4203543 - RNA, 106 nt, Human herpesvirus 1
ucgugaucgccacgcugaugcaccacggggugcucccggcggccccgggggacgucccccgggacgcgaguacccacguuaaccccgacggcguggcgcaccacga

SEQ ID NO: 4203544 - RNA, 79 nt, Human herpesvirus 1
agaacacgcgguccccugugguguuuuugguuauuuuuauuaaaucucgucgacaaacagggggaaaggggcguggucu

SEQ ID NO: 4203545 - RNA, 55 nt, Human herpesvirus 1
agcguucgcacuucgucccaauauauauauauuauuagggcgaagugcgagcacu

SEQ ID NO: 4203546 - RNA, 75 nt, Human herpesvirus 1
cacccccuggcccucgguauaccccagcugcccguggagaaucucgcggaacagcaucguaccggggcuggggug

SEQ ID NO: 4203547 - RNA, 77 nt, Human herpesvirus 1
ccaccgggcccacgggcuuccggagacggcgcucuuggccgagaaccuccccggguugcucguacaccgcuuggugg

SEQ ID NO: 4203548 - RNA, 100 nt, Human herpesvirus 1
cccaggccggccgcguggccgucgagugccuggccgccugccgcgggauccuggaggcgcuggccgagggcuucgacggcgaccuggcggccgucccggg

SEQ ID NO: 4203549 - RNA, 57 nt, Human herpesvirus 1
cccaugcggcguuggaugagcucccgcgcgccccggaacuccuccaccgcccauggg

SEQ ID NO: 4203550 - RNA, 59 nt, Human herpesvirus 1
cccccgagucggacccggaggccccacgggcgauggccuccgaagggacggcuccgggg

SEQ ID NO: 4203551 - RNA, 56 nt, Human herpesvirus 1
cccgcgagucggagcuggagcugugucucacgcuguuugacucacgcgcucgcggg

SEQ ID NO: 4203552 - RNA, 62 nt, Human herpesvirus 1
ccggacccccaggcucgcccgggccggcaugugcaagggccuuguuugucuggcggauccgg

SEQ ID NO: 4203553 - RNA, 74 nt, Human herpesvirus 1
ccuuucaaagaagcucacauaguccccacccaggcugugcaggacacggaucucccggggggaagcgagauagg

SEQ ID NO: 4203554 - RNA, 89 nt, Human herpesvirus 1
cgaggcuguaguccccccaggccccuaggucgcgacggcucguaagcacgacgcggucggccgcggggcuuugcgggggggcguccucg

SEQ ID NO: 4203555 - RNA, 67 nt, Human herpesvirus 1
cgagguacggggcggcccgugcggguugcuuaaaugcgugguggcgaccacgggcugucauuccucg

SEQ ID NO: 4203556 - RNA, 77 nt, Human herpesvirus 1
cggagcucgcggcacgcgcgauagagucgacgaccuggggacggacgucgacucuaucgcgcgcauugucaacuccg

SEQ ID NO: 4203557 - RNA, 56 nt, Human herpesvirus 1
cgguuccgcgguaccccgagucgauaagacccaguauuacguggugcccggggcug

SEQ ID NO: 4203558 - RNA, 59 nt, Human herpesvirus 1
cgucgagcguaccgacgggcggcacaccuaucacgugacuggccgucaggagcucggcg

SEQ ID NO: 4203559 - RNA, 59 nt, Human herpesvirus 1
cguggacaggcucuggagcauccgcacgacugcggugauauuaccggagaccuucugcg

SEQ ID NO: 4203560 - RNA, 56 nt, Human herpesvirus 1
cguugcggagcaucccgcgccuuggccgugauggcacgcggggugguuccgucacg

SEQ ID NO: 4203561 - RNA, 129 nt, Human herpesvirus 1
cucgaucucccggacgacgacgcccccgaagaggcggggcuggcggcuccgcgccuguccuuucuccccgcgggacacacgcgcagacugucgacggcccccccgaccgaugucagccugggggacgag

SEQ ID NO: 4203562 - RNA, 66 nt, Human herpesvirus 1
cucgugggggaguuugagacggccgagcgccgcuuuaguuccggucaacccagccuucuccgcgag

SEQ ID NO: 4203563 - RNA, 78 nt, Human herpesvirus 1
gacacgcucgcgccagaggggcgagguccguuucguccaguacgacgagucggauuaugcccucuacgggggcucguc

SEQ ID NO: 4203564 - RNA, 57 nt, Human herpesvirus 1
gaugugcgucgcguuguaccugcgggcgaagaugcgguccauggcgucgcgggcguc

SEQ ID NO: 4203565 - RNA, 65 nt, Human herpesvirus 1
gcaagacgaucguccacggcguccaggcgcucaccaagcgccggaucgagguaccgucggugugc

SEQ ID NO: 4203566 - RNA, 105 nt, Human herpesvirus 1
gcaggcgcuaauauccaacacaauaucacagcccaucaacaggaggucaguguccgugguguacacguacgcgaccguguuggugugauagagguuggcgcaggc

SEQ ID NO: 4203567 - RNA, 80 nt, Human herpesvirus 1
gccacgcgcguggagucgaaggccagcgccagcucaaaaaacccggggccggcgcgcuccgcggccuccgcgaccguggc

SEQ ID NO: 4203568 - RNA, 130 nt, Human herpesvirus 1
ggguugacgcuggggguccugguggcgucggcggcuccgaguucccccggcacgccuggggucgcggccgcgacccaggcggcgaacgggggcccugccacuccggcgccgcccgccccuggcgcccccc

SEQ ID NO: 4203569 - RNA, 55 nt, Human herpesvirus 1
ggucccggcgcuggcgguaagugaauaccagguacagaaacgccgcgcccgggcc

SEQ ID NO: 4203570 - RNA, 67 nt, Human herpesvirus 1
ggucgucggcgggcugacgaucggaggcagcgcgcgcuacugguggaucggugggcccgccgcggcc

SEQ ID NO: 4203571 - RNA, 81 nt, Human herpesvirus 1
guacacccccuggcccucgguauaccccagcugcccguggagaaucucgcggaacagcaucguaccggggcuggggugaac

SEQ ID NO: 4203572 - RNA, 66 nt, Human herpesvirus 1
guagggcgacaggauuugggaccuaccaacggaacgucuggacggaccccgguucugccgccggac

SEQ ID NO: 4203573 - RNA, 60 nt, Human herpesvirus 2
aacggcgcccggaggacggccguggcguaaaacagcgcucggcggaccaucggggcgguu

SEQ ID NO: 4203574 - RNA, 70 nt, Human herpesvirus 2
acauuguccacguaggugcugaagggggcgcucucaaacaccuccccgaagagcucccguaggauaaggu

SEQ ID NO: 4203575 - RNA, 62 nt, Human herpesvirus 2
agugguuaaaucgaccgugaugcuuuauugucugucgucugaacgcggucggggucgcuacu

SEQ ID NO: 4203576 - RNA, 130 nt, Human herpesvirus 2
caagcaacagcuagucguggcccggaacgacaucacguacguccucaacagccaggucgcggugaccgcgcgccuccgaaagaugguguuuggguucgacgggacguuucggaccuucgaggcugugcug

SEQ ID NO: 4203577 - RNA, 64 nt, Human herpesvirus 2
cacgaagccccggcggguuuguccgcuucguaacuucgauacguaacgcccugggguugccgug

SEQ ID NO: 4203578 - RNA, 60 nt, Human herpesvirus 2
cccgcggcgucgcgacagaccagauacagcagggcguggaggcagucgcgcgugcgcggg

SEQ ID NO: 4203579 - RNA, 120 nt, Human herpesvirus 2
ccgaggggccgcgggggucgagugggggcgagcccgggggagcggcgggggugcguugucgcgccggguccguuguaucuugucccggcagcucccgccgaccgcgccgcggccccccgg

SEQ ID NO: 4203580 - RNA, 63 nt, Human herpesvirus 2
ccgcgaauagcuacggccgcuugccaguccccaucggcauuccgguuggugcuguccgucugg

SEQ ID NO: 4203581 - RNA, 65 nt, Human herpesvirus 2
ccgggggggggcaagugcaguaacccaguuccucaguguuugggaaaucuauugaacucucccgg

SEQ ID NO: 4203582 - RNA, 75 nt, Human herpesvirus 2
cgacagccccaggggcuguucgggggucguagaugcggaaaacaucacgcccggcggacagccucuagggcgacg

SEQ ID NO: 4203583 - RNA, 65 nt, Human herpesvirus 2
cgcgggcccgguucgaggccucgggcgccccggcgcccgugugggcgcccgagcugggcgacgcg

SEQ ID NO: 4203584 - RNA, 82 nt, Human herpesvirus 2
cgcggggagcgaggggccguccgaacguuuuuaauuaccauaagcgggaauggcggcccguuaaaagcugcuaauuaccgcg

SEQ ID NO: 4203585 - RNA, 71 nt, Human herpesvirus 2
cgcggggccaacgugcgguaccgcgugcgcacgcgcuucggccccgacacgcuggugcccauguccccgcg

SEQ ID NO: 4203586 - RNA, 66 nt, Human herpesvirus 2
cugcugcagcuaggggagccgcccuccgccggggcccagcaacggcuccucgcgcugcugcagcag

SEQ ID NO: 4203587 - RNA, 129 nt, Human herpesvirus 2
gacccgcgcggcgccagccaccccgcgcucgcugucgcucuugcgccccaacagcaccuugacggacgcgguguugcgcagacggcagaugugcgcguguucccggagggcguggcacgcgacgaucuc

SEQ ID NO: 4203588 - RNA, 63 nt, Human herpesvirus 2
gagcaucgccuccagggcgugggcgcgcucccgaagccgggagcgcgccuccggagcgagcuc

SEQ ID NO: 4203589 - RNA, 59 nt, Human herpesvirus 2
gagggcggccucggccggcggagccccggagcuccgaaggucugcgcgaggccgcucuc

SEQ ID NO: 4203590 - RNA, 69 nt, Human herpesvirus 2
gccacccguggucucgggagcagggcgcgcccgcgccggccggcgacgcccccgcgggccacggggagu

SEQ ID NO: 4203591 - RNA, 104 nt, Human herpesvirus 2
gccagccaccccgcgcucgcugucgcucuugcgccccaacagcaccuugacggacgcgguguugcgcagacggcagaugugcgcguguucccggagggcguggc

SEQ ID NO: 4203592 - RNA, 66 nt, Human herpesvirus 2
gccccaggggcuguucgggggucguagaugcggaaaacaucacgcccggcggacagccucuagggc

SEQ ID NO: 4203593 - RNA, 69 nt, Human herpesvirus 2
gccggcgucccggucgccgccgcaccaggggcacaccggcugcgcggcggagaccgggacggcagcggc

SEQ ID NO: 4203594 - RNA, 90 nt, Human herpesvirus 2
gccggcguuucuguccgcggccaaacugcacgccgccacggcggcguuucuguugucgggcgcggcggucggcccggcggaggcgcgggc

SEQ ID NO: 4203595 - RNA, 58 nt, Human herpesvirus 2
gccugcuggccacguacgcaauuacgucuacgcuguugcuggcggcggccguguacgc

SEQ ID NO: 4203596 - RNA, 58 nt, Human herpesvirus 2
gcggaccuggugcccggacgucccgcgagcccuccccgccggacgccgccauggccgc

SEQ ID NO: 4203597 - RNA, 55 nt, Human herpesvirus 2
gcgggcgagggcgucuaaggccucgcgcaucucgcgggccuccgccucgacccgc

SEQ ID NO: 4203598 - RNA, 87 nt, Human herpesvirus 2
gcgucgucgcccuagaggcuguccgccgggcgugauguuuuccgcaucuacgacccccgaacagccccuggggcugucgggcgaugc

SEQ ID NO: 4203599 - RNA, 80 nt, Human herpesvirus 2
gcugcccgccucggagguggagucgcggugaaggucgucgucagagauucccaccucggucuccuccuccgagucgcugc

SEQ ID NO: 4203600 - RNA, 84 nt, Human herpesvirus 2
gcugcccgccucggagguggagucgcggugaaggucgucgucagagauucccaccucggucuccuccuccgagucgcugcuggc

SEQ ID NO: 4203601 - RNA, 57 nt, Human herpesvirus 2
gcuguacgcguguuccacgugcuccaggaugucguacacguggaagacggugacggu

SEQ ID NO: 4203602 - RNA, 91 nt, Human herpesvirus 2
ggacgaucccgggcccuuggguuccgcggacgccgggcggcaagaccugccccggcgcgucguccgucacgagccccugggccgcucguuc

SEQ ID NO: 4203603 - RNA, 85 nt, Human herpesvirus 2
ggagaguggcuccuggagcgcucgcgcgcccacccgaacacccuguucgcccccgccaccccgacgcacccggagccgcuucucc

SEQ ID NO: 4203604 - RNA, 63 nt, Human herpesvirus 2
ggaucgucggcuccccgccgcgcugccgggcgaggcgucgaggcuucgggggugccggcgucc

SEQ ID NO: 4203605 - RNA, 61 nt, Human herpesvirus 2
ggcccggguaccgcccgcguucccggaaccgccgggaaccaagcggaggcaccccggggcc

SEQ ID NO: 4203606 - RNA, 68 nt, Human herpesvirus 2
gggagaaggccgugguguugcggagcgccaccacgacgggcgcgccgaggagcaccgcggccagaacc

SEQ ID NO: 4203607 - RNA, 127 nt, Human herpesvirus 2
gggcccgcccccggcgcggcccgcggccagguccucgcccggcagcggcgaguagaggaucaccacgcgcacguccuccgggucgggcaccuggcgcauccaggccgccgcgcggcgcagcgggccc

SEQ ID NO: 4203608 - RNA, 104 nt, Human herpesvirus 2
ggggccagggcuggcaccguaucagcaccccaccgaaaaacggagcgggccgauccguccuuguuuucggucugguacucccuuugugcuuuuacccucacccc

SEQ ID NO: 4203609 - RNA, 130 nt, Human herpesvirus 2
ggggcgaagagaugcgggucgaggcggaggcccgcgagaugcgcgaggccuuagacgcccucgcccgcggggucgacucggucucgcagcgcgccgggccccugaccgugaugcccgugcccgccgcccc

SEQ ID NO: 4203610 - RNA, 62 nt, Human herpesvirus 2
ggucacccuggaguugcuccuggaguacgcguggcgcgagggggagcggcuccugggccacc

SEQ ID NO: 4203611 - RNA, 74 nt, Human herpesvirus 2
ggucuuccacgagcucgcggcaccccggcgggcgcuuaaacugcacgucgcuggcagcgguggccguggauacc

SEQ ID NO: 4203612 - RNA, 84 nt, Human herpesvirus 2
ggugacguuuuucucgccgucgagguggcggaucaggcgcuugaagaacagguccggcauccagagggcgcugaagauguuguc

SEQ ID NO: 4203613 - RNA, 56 nt, Human herpesvirus 2
gguggucccggagaucgcccccggugaggagugcccgagcgaucccgugaccgacc

SEQ ID NO: 4203614 - RNA, 61 nt, Human herpesvirus 2
guccguguugagcggaacgccccgggcgauggcguacccgggauccuccgccagcucggac

SEQ ID NO: 4203615 - RNA, 56 nt, Human herpesvirus 2
gucugggggccuuucucuguguggccaaaaguugcgcaucucgagggccccgggac

SEQ ID NO: 4203616 - RNA, 63 nt, Human herpesvirus 2
guggcgucggugguucuggucguggagcccgccccugugccgaccccgacccccgacgacuac

SEQ ID NO: 4203617 - RNA, 64 nt, Human herpesvirus 2
gugugcggccgcgacaugucccacagcuguaccgccgccagccgggcgugcguggccgccaggc

SEQ ID NO: 4203618 - RNA, 63 nt, Human herpesvirus 2
guguuuacggaggcgaguugcuggacgucggccacgagcgagagacgggccccguuguaauac

SEQ ID NO: 4203619 - RNA, 55 nt, Human herpesvirus 2
ucucauuagcgcccggcgcgggcggcuuccgcuuccgcccgcgaugcuaaugaga

SEQ ID NO: 4203620 - RNA, 68 nt, Human herpesvirus 2
uugguggcggcguagaugcgucucuccagggccuccaggaagaccagccugucgccuauggccaccag

SEQ ID NO: 4203621 - RNA, 60 nt, Human herpesvirus 2
accgguccccgccccguacguugugcacggcucccugacgaugcgugggguggcgagggu

SEQ ID NO: 4203622 - RNA, 55 nt, Human herpesvirus 2
acgcgggugcuggugucucggggaacgucgcccggggccgccgguagcaccccgu

SEQ ID NO: 4203623 - RNA, 80 nt, Human herpesvirus 2
augcugcucgcggccaugaagaccaguaacgcgcugugcguucgcggggcgcgucccuucagccacuuuaagcgcagcau

SEQ ID NO: 4203624 - RNA, 70 nt, Human herpesvirus 2
cccacaaaguccgggaggggccgcaggaccccuuggaguuugugcaggaacuucucccgggcgucguggg

SEQ ID NO: 4203625 - RNA, 75 nt, Human herpesvirus 2
ccggcgcgcucucgaccgcgguucccgagucguacgcagggaccauuugggagucugcgguugggagcgcgccgg

SEQ ID NO: 4203626 - RNA, 102 nt, Human herpesvirus 2
cgagccugcggcgcacgcucgugggggaguuugagacggccgagcgccgcuucagcgccggccagcccagccuccugcgcgagacggcgcucaucuggcucg

SEQ ID NO: 4203627 - RNA, 79 nt, Human herpesvirus 2
cgaggccgacgaugacgccccggaugacguggccuacccggaggacuacgcggaggggcguuuucuguccaugguuucg

SEQ ID NO: 4203628 - RNA, 101 nt, Human herpesvirus 2
cgcgcgcgcaugugcgccaguuccugcugcagggacgucaccgcccccaccagcgccgugaugguuucguggggcccggaagccuggcgcgcggcgcgccg

SEQ ID NO: 4203629 - RNA, 78 nt, Human herpesvirus 2
cgggacgggugaguucgcuaggcaagcacggacuggcgguuacacgugcaugcgugccgagugaacucucccgccccg

SEQ ID NO: 4203630 - RNA, 108 nt, Human herpesvirus 2
cgggcgcgggcgacgccauggcgcccggcgcgccggacuucugcgaggacgaggcgcacucgcaccgcgccugcgcgcgcuggggccugggcgcgccgcugcggcccg

SEQ ID NO: 4203631 - RNA, 85 nt, Human herpesvirus 2
cgggguaggguagacucgagacggcggcccgcggucucucucuugccggguuuuagucucugucucuccgggucuccuccucccg

SEQ ID NO: 4203632 - RNA, 84 nt, Human herpesvirus 2
cggugagcguccucgggcgcaugugucugccgagcgccgcuuuggccgcgcuguggaccugcauguuucccgacgacuacaccg

SEQ ID NO: 4203633 - RNA, 79 nt, Human herpesvirus 2
cucgcgcggggacaugggcaccagcgugucggggccgaagcgcgugcgcacgcgguaccgcacguuggccccgcggcag

SEQ ID NO: 4203634 - RNA, 58 nt, Human herpesvirus 2
cuggcgggcgggacgguggcucgcccccuuucauaggcgcgcgccaaccgcccaccag

SEQ ID NO: 4203635 - RNA, 129 nt, Human herpesvirus 2
gaccgccagcgggucguucagcaccaucccgauagugaacgacccccggacccgcguggaggccgaggcggccgugcgggccggcacggccguggacuuuaucuggacgggcaacccgcggacggcccc

SEQ ID NO: 4203636 - RNA, 81 nt, Human herpesvirus 2
gcaccgaugccgugccgcuggcguugcgccgagagaacgacacggagucgcggugccacgucagcuggcaggugaaggugc

SEQ ID NO: 4203637 - RNA, 94 nt, Human herpesvirus 2
gccccaggagcccggccucgucgaugacgauaauguugcugcgggugaaagccggcagcgccccgugugugaccgaggccaggcgcgugagggc

SEQ ID NO: 4203638 - RNA, 81 nt, Human herpesvirus 2
gcccgccucggagguggagucgcggugaaggucgucgucagagauucccaccucggucuccuccuccgagucgcugcuggc

SEQ ID NO: 4203639 - RNA, 84 nt, Human herpesvirus 2
gcccugggcccgggccgugcuggagcgccuggugccggacgcgugcgacgccugccccgcgcuccggcagcugcucggcggggu

SEQ ID NO: 4203640 - RNA, 93 nt, Human herpesvirus 2
gccgacgcccugcuggaggcgcaugacguguuucaggccacuacgcccggccuguacgccaucagcgagcugcgcuucuggcuggcguccggc

SEQ ID NO: 4203641 - RNA, 58 nt, Human herpesvirus 2
gcgcacggacggcgaccugcggcgcgggaacgcucgcggcgggggauguguccauggc

SEQ ID NO: 4203642 - RNA, 124 nt, Human herpesvirus 2
gcgcauauggacgaccgcguccgacggagaggccguggagcuugccagcgagacgcucaugaaacgcgaguugacgagcuucgcgguacuacucccccagggcgaccccgacguccagcugcgc

SEQ ID NO: 4203643 - RNA, 64 nt, Human herpesvirus 2
gcgcguggcgcccggggacguggcgcuggaccaggccugcuuccggaucucgggcgcggcgcgc

SEQ ID NO: 4203644 - RNA, 66 nt, Human herpesvirus 2
gcggacggcgucgucucgccgcggcagcuggcccugcuggccucgaugguggacgaggccguucgc

SEQ ID NO: 4203645 - RNA, 105 nt, Human herpesvirus 2
gcugcuguguccuccggacgugcgaucggaucccgcgagucgaaaucccacacagcagacccgugggugugcuagaucgaacgagcggcaggaucgcgugcuggc

SEQ ID NO: 4203646 - RNA, 71 nt, Human herpesvirus 2
gcuuuugggucgggcucagggccagcgcggccccgagaaacgcccgcggagcccccaccgacccaaacagc

SEQ ID NO: 4203647 - RNA, 104 nt, Human herpesvirus 2
ggacgacgggcgcccccgccucgccugcgugggugccaucgcucggggguucgcgcaucucuggcuccaggccgccacgcugggcuucguggggucugucguuc

SEQ ID NO: 4203648 - RNA, 127 nt, Human herpesvirus 2
ggccguccgcggguugcccguccagauaaaguccacggccgugccggcccgcacggccgccucggccuccacgcggguccgggggucguucacuaucgggauggugcugaacgacccgcuggcgguc

SEQ ID NO: 4203649 - RNA, 90 nt, Human herpesvirus 2
ggcuuaccgguuacacuguccgcucgcuaugggguucgucugucuguuugggcuugucguuaugggagccuggggggcgugggguggguc

SEQ ID NO: 4203650 - RNA, 83 nt, Human herpesvirus 2
gggacccgcaccgcggggcuuggagcgaccgaggccccccccgggccuacgagggcacaagccccggagguugcgucgguccc

SEQ ID NO: 4203651 - RNA, 77 nt, Human herpesvirus 2
gggccagcacguggccgugcuggccgccgcgacccaccgcacccccgccgcgcgcguuacggccauggaccugguuc

SEQ ID NO: 4203652 - RNA, 82 nt, Human herpesvirus 2
gggcgaggccgggucgcgggcggccgcgcccagggccgacaccgcguccgccagggcgccaugcgcccgcacggccgcgucc

SEQ ID NO: 4203653 - RNA, 130 nt, Human herpesvirus 2
gggcguggccgcccuucuaaaaaaagugagaacgcgaagcguucgcacuuuguccuaauaguauauauauuauuaggacaaagugcgaacgcuucgcguucucacuuuuuuuagaagggcggccacgccc

SEQ ID NO: 4203654 - RNA, 103 nt, Human herpesvirus 2
ggggcgaccaucgcccgccgccuggcggaccgcaucuguaaccacgucacccaacaggcccaggugcggcuggacgccaacgagcugcgacgguaccugcccc

SEQ ID NO: 4203655 - RNA, 113 nt, Human herpesvirus 2
gggucgcgggucccuggguaugcgcgggacccuggguucucugggagaucguggaacucgcgguucccugggcucucggggaacccggggcucccuggggacacguggugccc

SEQ ID NO: 4203656 - RNA, 116 nt, Human herpesvirus 2
guacucggucagguugguggugaagguggucgagauggcgucggaggagaagcggaaggagccgccguacucggcgcggagcaucucguccaccuccugccacuuggucauggugc

SEQ ID NO: 4203657 - RNA, 63 nt, Human herpesvirus 2
guccccgcccaggcuguggaggacgcggaucucccgcggggccgcggaaaacaugggcggggc

SEQ ID NO: 4203658 - RNA, 57 nt, Human herpesvirus 2
gucggcgcggggguggccaaacaggacccaggggucgacuuccaucuccgugauggc

SEQ ID NO: 4203659 - RNA, 88 nt, Human herpesvirus 2
gugacaaaccccggguuguccaggauaaaccgggugguggcgucgacgccccccucguacuuccugaucgcggggcaaaaguugucgc

SEQ ID NO: 4203660 - RNA, 99 nt, Human herpesvirus 2
gugggccacgucgucgggguucacgcgggugcuggugucucggggaacgucgcccggggccgccgguagcaccccguggcgcaccaacguggcgaucac

SEQ ID NO: 4203661 - RNA, 123 nt, Human herpesvirus 2
guuguugaccacggccgucugaaacgccuggcgaagcugcugcggucgcgcccccggguccugggggcgcgacccgcggccggugccgcccuugccgaacccagggaggguguggucgacggc

SEQ ID NO: 4203662 - RNA, 59 nt, Human herpesvirus 2
acgcaccuccgggccgagguguacagggaccagacccugcagcuacaccgggagggcgu

SEQ ID NO: 4203663 - RNA, 61 nt, Human herpesvirus 2
cacggccgacguccccagcgugugugucaccgccaccggccccaacgcggugucggcggug

SEQ ID NO: 4203664 - RNA, 87 nt, Human herpesvirus 2
ccgcgcgccccggucgcgcaugacccaggcucagaccgacacccaagcacagagucugggccgggcaggcgcgaccgacgcgcgcgg

SEQ ID NO: 4203665 - RNA, 66 nt, Human herpesvirus 2
ccucggccgguggcgacgacggcgacggggacugguuccccgacgccgguggucccggcgacgagg

SEQ ID NO: 4203666 - RNA, 56 nt, Human herpesvirus 2
cgagguuggccccguucaagaccaucucgccguaggucaccggcacgucggccucg

SEQ ID NO: 4203667 - RNA, 74 nt, Human herpesvirus 2
cgcgcucgcugucgcucuugcgccccaacagcaccuugacggacgcgguguugcgcagacggcagaugugcgcg

SEQ ID NO: 4203668 - RNA, 55 nt, Human herpesvirus 2
cgcuguucgaggccacgcgcgucaccuuaauaugcgaaguggaccucgggccgcg

SEQ ID NO: 4203669 - RNA, 61 nt, Human herpesvirus 2
cggcagggcguuucguuggucuaggaggguaaccacacuuacaacaacaacgcccaugucg

SEQ ID NO: 4203670 - RNA, 71 nt, Human herpesvirus 2
cggcaugguggaccgcgggcucggccggcaccucuggcgccugacgcgccgcgcccccccguccgccgccg

SEQ ID NO: 4203671 - RNA, 62 nt, Human herpesvirus 2
cggccugcccgcgaagaaacucucgcaccgcacccugcguuccgugcggaugcggguagcug

SEQ ID NO: 4203672 - RNA, 74 nt, Human herpesvirus 2
cuacgacugucugauccacagcaccccgaacacgcucgucgagcgggggcugcagucggcgcugaaguacgaag

SEQ ID NO: 4203673 - RNA, 67 nt, Human herpesvirus 2
cucgucggcggccccgcggagguuguacaaaaagcucgugcuggccuucccgguguuggucgacgag

SEQ ID NO: 4203674 - RNA, 93 nt, Human herpesvirus 2
cugcgcuuugggcagcuugucgucgcgguagcgguacugcgggcguccgcucucgucgccgauuaccgcggccagacgcgccagguagcgcgg

SEQ ID NO: 4203675 - RNA, 73 nt, Human herpesvirus 2
cuggcgaucacguacagcucgcgcagcagcugcucgauguugucggccaucugcaucgugggcccgacgccgg

SEQ ID NO: 4203676 - RNA, 76 nt, Human herpesvirus 2
gacggcggacccgcggaggaggaggaggcggcggcggcggcgcgcggguccuccgccgccgcgggcccgggccguc

SEQ ID NO: 4203677 - RNA, 70 nt, Human herpesvirus 2
gccucggagguggagucgcggugaaggucgucgucagagauucccaccucggucuccuccuccgagucgc

SEQ ID NO: 4203678 - RNA, 66 nt, Human herpesvirus 2
gcgccccgacggcccggugcguaacugugguccgcgcgccaaugggcucgggaaaaacuaccgcgc

SEQ ID NO: 4203679 - RNA, 88 nt, Human herpesvirus 2
gcggaaaaacggaggauggaagggcagaagauggggagucccgauccuccuccugcauccccucgccuuccauucuccggcccuccgc

SEQ ID NO: 4203680 - RNA, 82 nt, Human herpesvirus 2
gcggcuuggcgguccccggcacgagggugagcacgucguugaggacguccucgcccgcggcccgggggcccccccggcuggc

SEQ ID NO: 4203681 - RNA, 110 nt, Human herpesvirus 2
gcgucgcaucucagcgagcgcguaguucaggagcccaaagucguccuccgugaggcggggggcgcugccgaagguucgugggggcacgcgcuugcucuccucgcgggcgc

SEQ ID NO: 4203682 - RNA, 62 nt, Human herpesvirus 2
gcugcagcagcgcgaggagccguugcugggccccggcggagggcggcuccccuagcugcagc

SEQ ID NO: 4203683 - RNA, 88 nt, Human herpesvirus 2
gcuuucgcugaugcgcucgaccgccgcgcgcucggauauggaucgcagaaccgcccgaacggcggggucgauggugucggcagagggc

SEQ ID NO: 4203684 - RNA, 63 nt, Human herpesvirus 2
ggacgccggcacccccgaagccucgacgccucgcccggcagcgcggcggggagccgacgaucc

SEQ ID NO: 4203685 - RNA, 130 nt, Human herpesvirus 2
ggaggcguuccgggcguucauccgguccauccccaaccccggcgugcgcuacuucgcgcccgggcgcguuccgggcccggaggaggcgcucgucacccaagaccgggacuggcucgauucccgcgccgcc

SEQ ID NO: 4203686 - RNA, 59 nt, Human herpesvirus 2
ggcagggcguuucguuggucuaggaggguaaccacacuuacaacaacaacgcccauguc

SEQ ID NO: 4203687 - RNA, 63 nt, Human herpesvirus 2
ggcgccagggccacgacgcucgagacccccgcgaugggcagguagcgcgugaggccgggcgcc

SEQ ID NO: 4203688 - RNA, 78 nt, Human herpesvirus 2
ggcuggagaccgagcucguguucgugggggacgaggaggacgucuccaagcucuccgagggcgagcucggcuucuacc

SEQ ID NO: 4203689 - RNA, 71 nt, Human herpesvirus 2
gggcgccagcgcucgcacuuugcccuaauaauauauauacuauuaggacgaagugcgaacgcuucgcguuc

SEQ ID NO: 4203690 - RNA, 61 nt, Human herpesvirus 2
guccgagcuggcggaggaucccggguacgccaucgcccggggcguuccgcucaacacggac

SEQ ID NO: 4203691 - RNA, 91 nt, Human herpesvirus 2
guggcucgccagcagcgacucggaggaggagaccgaggugggaaucucugacgacgaccuucaccgcgacuccaccuccgaggcgggcagc

SEQ ID NO: 4203692 - RNA, 97 nt, Human herpesvirus 2
guuccccacccugcccgccacccgcgacgagcugccuucguacuacgaggccauggcgcaguuuuuccgcggugagcugcgggcgcgggaggagagc

SEQ ID NO: 4203693 - RNA, 77 nt, Human herpesvirus 2
uccggcgucgccucggggcuccgccagggcgcccugguccaccaggccgucagcgggggagcccugggcgcgucgga

SEQ ID NO: 4203694 - RNA, 57 nt, Human herpesvirus 2
uccuucgccgacgccuucccugugauccgcacgggcguccccggugucuccgauaga

SEQ ID NO: 4203695 - RNA, 55 nt, Human herpesvirus 2
ucgaccccgccguucgggcgguucugcgauccauauccgagcgcgcggcggucga

SEQ ID NO: 4203696 - RNA, 55 nt, Human herpesvirus 2
uggaucuccgcgcagacaucgccauacguccggugugugcaccgcgaagaaucca

SEQ ID NO: 4203697 - RNA, 71 nt, Human herpesvirus 2
uucggccuuccgccggcccgggggcccccggggaccuggaggcccaagaugccggcgguagcacccccgaa

SEQ ID NO: 4203698 - RNA, 56 nt, Human herpesvirus 2
acguacugcagggccucgagcucggccaugacgcgcucgguggccgcgcgguacgu

SEQ ID NO: 4203699 - RNA, 55 nt, Human herpesvirus 2
acugggccgucgugcgggccaggaucgccuuggccccgaacacaaccggcucggu

SEQ ID NO: 4203700 - RNA, 66 nt, Human herpesvirus 2
agaccugguuuuuggugccccucaucgcgcugucgcucgcguccuuccgggggaucaagauaggcu

SEQ ID NO: 4203701 - RNA, 63 nt, Human herpesvirus 2
cacuuugacagcauguucgccuacgugaaacccaugaacuacgggccggacaugguguccgug

SEQ ID NO: 4203702 - RNA, 69 nt, Human herpesvirus 2
cccacgaagccccggcggguuuguccgcuucguaacuucgauacguaacgcccugggguugccgugagg

SEQ ID NO: 4203703 - RNA, 61 nt, Human herpesvirus 2
ccccgcccuccgcuacacgacccuggagauccccggggcccgcagcuucgggggcucgggg

SEQ ID NO: 4203704 - RNA, 65 nt, Human herpesvirus 2
ccccgcgaauagcuacggccgcuugccaguccccaucggcauuccgguuggugcuguccgucugg

SEQ ID NO: 4203705 - RNA, 91 nt, Human herpesvirus 2
cccgcccgacccccgcccgcccucaccgucggccaggucaucguccucgucguccgugccgggccacgggggggugggcgacagggcgcgg

SEQ ID NO: 4203706 - RNA, 87 nt, Human herpesvirus 2
ccgcgcgcgucggucgcgccugcccggcccagacucugugcuugggugucggucugagccugggucaugcgcgaccggggcgcgcgg

SEQ ID NO: 4203707 - RNA, 69 nt, Human herpesvirus 2
ccgcggagauggagguucagaucguacgcaacgacccgccgcuacgauacgauaccaaccuccccgugg

SEQ ID NO: 4203708 - RNA, 68 nt, Human herpesvirus 2
ccgggcuuccggcagcccggccuccccgaggcccgcgagggcggccaggagcugggccuggagcccgg

SEQ ID NO: 4203709 - RNA, 88 nt, Human herpesvirus 2
ccuccgcgaagcgcgcgcgcgccucccccgcggcgucgcgacagaccagauacagcagggcguggaggcagucgcgcgugcgcggggg

SEQ ID NO: 4203710 - RNA, 76 nt, Human herpesvirus 2
cgagcugcccugucugaacgccaggcguuacggccccgagugugauguuggcaaucucgagaccaacggcggcucg

SEQ ID NO: 4203711 - RNA, 62 nt, Human herpesvirus 2
cgcccccggggcuccaggaggccgccccgccgggccccccgcucagggagcuguggugggug

SEQ ID NO: 4203712 - RNA, 65 nt, Human herpesvirus 2
cgcgaagcguucgcacuucguccuaauaguauauauauuauuagggcaaagugcgagcgcuggcg

SEQ ID NO: 4203713 - RNA, 120 nt, Human herpesvirus 2
cgcgcggcgccagccaccccgcgcucgcugucgcucuugcgccccaacagcaccuugacggacgcgguguugcgcagacggcagaugugcgcguguucccggagggcguggcacgcgacg

SEQ ID NO: 4203714 - RNA, 82 nt, Human herpesvirus 2
cgcgcuuaugggcggccggccgcccgggugagcgugacgucaaagggggcguggccgcccuucuaaaaaaagugagaacgcg

SEQ ID NO: 4203715 - RNA, 95 nt, Human herpesvirus 2
cgucguccaggguggggcugaucugaauuucccgcagaaccucgaccaguaggucuguuguguuugcugggaacucgcccgccguuggggauacg

SEQ ID NO: 4203716 - RNA, 64 nt, Human herpesvirus 2
cucggaggaggagaccgaggugggaaucucugacgacgaccuucaccgcgacuccaccuccgag

SEQ ID NO: 4203717 - RNA, 72 nt, Human herpesvirus 2
cucguacccgggcaccacguggcccucgcgguccagcugcggguuggccgccacgugcgugccgggcacgag

SEQ ID NO: 4203718 - RNA, 78 nt, Human herpesvirus 2
gacgagguuccgcccgaccgcacccuguuugcgcacguggcccugugcgccaucgggcggcgccuuggaaccaucguc

SEQ ID NO: 4203719 - RNA, 67 nt, Human herpesvirus 2
gaggccgucgaacagaucgggccgcaucaucugcucggcguacgcggcccauaggaucucgcggcuc

SEQ ID NO: 4203720 - RNA, 77 nt, Human herpesvirus 2
gcagcgacucggaggaggagaccgaggugggaaucucugacgacgaccuucaccgcgacuccaccuccgaggcgggc

SEQ ID NO: 4203721 - RNA, 98 nt, Human herpesvirus 2
gcagcuccggggcaucauugcggagggcggggcggcggucgccagcagcguguuuguggcgaccgucaagagccugggcccccgcacccagcagcugc

SEQ ID NO: 4203722 - RNA, 70 nt, Human herpesvirus 2
gccagguccucgcccggcagcggcgaguagaggaucaccacgcgcacguccuccgggucgggcaccuggc

SEQ ID NO: 4203723 - RNA, 70 nt, Human herpesvirus 2
gccaggugcccgacccggaggacgugcgcguggugauccucuacucgccgcugccgggcgaggaccuggc

SEQ ID NO: 4203724 - RNA, 90 nt, Human herpesvirus 2
gcccgcccgcgacgagggucucauuagcaucgcgggcggaagcggaagccgcccgcgccgggcgcuaaugagaugccgcgcgggcggagc

SEQ ID NO: 4203725 - RNA, 70 nt, Human herpesvirus 2
gcgcgcccgauggucgugcugggccucagcaucagcaaauacuacggcauggccggcaacgaccgcgugu

SEQ ID NO: 4203726 - RNA, 79 nt, Human herpesvirus 2
gcgggggcugucgucuggcaugacacccagcucugcgaaggcggcguaugugcaggugcgugcgguagggcgcccccgc

SEQ ID NO: 4203727 - RNA, 66 nt, Human herpesvirus 2
gcugccgucccggucuccgccgcgcagccggugugccccuggugcggcggcgaccgggacgccggc

SEQ ID NO: 4203728 - RNA, 94 nt, Human herpesvirus 2
gcuggucgggcggaugacgcuuuccgcgccgucccggcccacgacgaccucgugcaggugggccgugaugcgcgggcggcgggucgccugccgc

SEQ ID NO: 4203729 - RNA, 83 nt, Human herpesvirus 2
gcuguauagggcgacggugcgcugguuuucggggauaaagcgggguagcaucccgaugcugucgaccgucacgcccuguuggu

SEQ ID NO: 4203730 - RNA, 80 nt, Human herpesvirus 2
ggaagggggggagaaagggguccguaaccaaagguggucugcguccuuuggauuccgaccccucgucucccccccugucc

SEQ ID NO: 4203731 - RNA, 76 nt, Human herpesvirus 2
ggagguggacgagaugcuccgcgccgaguacggcggcuccuuccgcuucuccuccgacgccaucucgaccaccuuc

SEQ ID NO: 4203732 - RNA, 86 nt, Human herpesvirus 2
ggcaacagaaggugggcgucgacgaggcgucggcgggccugacgcucggcggcgaugcgcugcgcgucccuuuuuuggauuuugcc

SEQ ID NO: 4203733 - RNA, 72 nt, Human herpesvirus 2
ggccgcguccguccgcacgcgcgccaucagcguccccgggggcgcgcacgccgaccgcgggcugacgcggcu

SEQ ID NO: 4203734 - RNA, 71 nt, Human herpesvirus 2
ggcgcgcccaccgguccuucgcgggggccggggcucuucuggucauggcccuuggacgggugggccuagcc

SEQ ID NO: 4203735 - RNA, 72 nt, Human herpesvirus 2
ggcggcggugccgucuggguggcuccccggggguuguggggggcaaaaaacccagacgccgcccgagccgcc

SEQ ID NO: 4203736 - RNA, 114 nt, Human herpesvirus 2
ggcguccucgccggcgaggaggcccagcgcugcgacaacaucuucagcgcccucuggaugccggaccuguucuucaagcgccugauccgccaccucgacggcgagaaaaacguc

SEQ ID NO: 4203737 - RNA, 56 nt, Human herpesvirus 2
gggcggugggucguggguguugagagcacacaggcgggacaccucgaucaccgucc

SEQ ID NO: 4203738 - RNA, 129 nt, Human herpesvirus 2
ggggcgucgggacucgcggagggccggagaauggaaggcgaggggaugcaggaggaggaucgggacuccccaucuucugcccuuccauccuccguuuuuccgcuuuccaccgccgccgccaccaccccc

SEQ ID NO: 4203739 - RNA, 59 nt, Human herpesvirus 2
guggccagcugccggggcagcgugugcugccugagaaacgcccccaggcgcugcgucgc

SEQ ID NO: 4203740 - RNA, 66 nt, Human herpesvirus 2
ucaccaccauucgcgugacggucugcgagggcaagaaccuccugcagcgcgcgaacgaguugguga

SEQ ID NO: 4203741 - RNA, 55 nt, Human herpesvirus 2
uccgcgucguggacaucauggcgcaguuucggaaacugcucaugggcgacgagga

SEQ ID NO: 4203742 - RNA, 55 nt, Human herpesvirus 2
ucgggaaggccucgucggacccauccuggccguggaacuggaaggcacaucucga

SEQ ID NO: 4203743 - RNA, 68 nt, Human herpesvirus 2
uucaccaacucguucgcgcgcugcaggagguucuugcccucgcagaccgucacgcgaaugguggugag

SEQ ID NO: 4203744 - RNA, 55 nt, Human herpesvirus 2
ucggugggcgaagacgugagggcucgcaggagaguggcgaccgucaaguccccga

SEQ ID NO: 4203745 - RNA, 66 nt, Human herpesvirus 2
ugguggccauaggcgacaggcuggucuuccuggaggcccuggagagacgcaucuacgccgccacca

SEQ ID NO: 4203746 - RNA, 89 nt, Human herpesvirus 3
aacguuuacccugaguguuuuuucuagcucuuggcgcuguucgcggauacaucuaccgaggcugguuagagagcgcuuagacagauguu

SEQ ID NO: 4203747 - RNA, 57 nt, Human herpesvirus 3
acaauuuugauacacugugcuugcaacacgcugggcuaaauguggcgagguaaaugu

SEQ ID NO: 4203748 - RNA, 69 nt, Human herpesvirus 3
ccgacgaacguccagggacgcgagguguuauaccccgggcaucauguuuccuugggcggguaucaucgg

SEQ ID NO: 4203749 - RNA, 118 nt, Human herpesvirus 3
cgaacaacgugccugaucugaacauacauugcgcguauguaaaucggugaagauuccccaaaauccaucuuuuauauaaguacauauagcaaagcccuguuccaaggccguuuguucg

SEQ ID NO: 4203750 - RNA, 64 nt, Human herpesvirus 3
cgccuuugcuuggguuucuauguccgcggcggacgugacaucuuuacgaauccaaugcaaaacg

SEQ ID NO: 4203751 - RNA, 61 nt, Human herpesvirus 3
cuguuuucccuuggcucuugugacuuaccacaaagguauguacaagaaaugaaggacgcgg

SEQ ID NO: 4203752 - RNA, 129 nt, Human herpesvirus 3
ggaggugcgguuaugucgcguugaccgucuagguaaggauccacgcgggugcacgucucaaccuaaagguauaggcaguucccacggacccuuagacggcauuuauuuaacguacgaagaaacaugucc

SEQ ID NO: 4203753 - RNA, 128 nt, Human herpesvirus 3
ggccguugggcaggccuccaaaaggcaauuugagcguuuuaaguuugggguacguuuuuaaagcuugauuggcaaacguuaccgcaaaucaaucuuagauccaagggauaauggccguugggcaggcc

SEQ ID NO: 4203754 - RNA, 66 nt, Human herpesvirus 3
ggucuccccggacgguccaaaccgcacccuguuggaugggaggggugccgauccgggccaagggcu

SEQ ID NO: 4203755 - RNA, 60 nt, Human herpesvirus 3
gguugugucggucucuccaagcucguuuuaugagaguuuacaaguagagcccacacaauc

SEQ ID NO: 4203756 - RNA, 67 nt, Human herpesvirus 3
gucuuaccgauuauaagagacugggacuuacaacauccgaguauaaacgcuuauauuuuuggaagau

SEQ ID NO: 4203757 - RNA, 57 nt, Human herpesvirus 3
guggguuaacgcucuuaacacgguugccucgguggccguuccuugacguugacccgc

SEQ ID NO: 4203758 - RNA, 64 nt, Human herpesvirus 3
aaguggagaaacagggaucgaccagaauaccgucguaaucuacgauucagacguuuuuucucuu

SEQ ID NO: 4203759 - RNA, 74 nt, Human herpesvirus 3
acguuauaaccuccgaaccguuccaugcgucuuguauaacgcacagacucugauggaauuguuccaauuaacgu

SEQ ID NO: 4203760 - RNA, 114 nt, Human herpesvirus 3
cccgguuucucccgcgugagccguucguaacauggccgcaucgcuugagcauagugguggauaugcuucuugaaaaaggccacacggauccugugucauuucgguagaaccggg

SEQ ID NO: 4203761 - RNA, 56 nt, Human herpesvirus 3
cgccugugaaauaacggucgcguguacgaaaaccgcagccuuuucuggucgaggcg

SEQ ID NO: 4203762 - RNA, 75 nt, Human herpesvirus 3
gcaacucagcagaugaugcuggaguccggacagcuggguguacaucuggcggcuauuggguaucacugucauugu

SEQ ID NO: 4203763 - RNA, 107 nt, Human herpesvirus 3
gccauaucucccauuaacucuuguagugugagcaaugcaucaccaucaacgguuaggugugcauuauggaaguaaacguuaagagaguucggaacgaguuggugugc

SEQ ID NO: 4203764 - RNA, 80 nt, Human herpesvirus 3
gcccggccgcauguugcucgaagagcacauaaccucuuaacaccguacagaggggauggcgucggugcaugugaguuggc

SEQ ID NO: 4203765 - RNA, 86 nt, Human herpesvirus 3
ggcuauggaaccuaauuuaauagggcuaugucccgccggauggcaugcucggauacuuggcucuguauuaaaucgacuccucagcc

SEQ ID NO: 4203766 - RNA, 61 nt, Human herpesvirus 3
ggguggguuaacgcucuuaacacgguugccucgguggccguuccuugacguugacccgcuu

SEQ ID NO: 4203767 - RNA, 61 nt, Human herpesvirus 3
gucugacgugguaagugcggcuucaccagagucuucugucaaguugcauguuaacgucgac

SEQ ID NO: 4203768 - RNA, 65 nt, Human herpesvirus 3
gugucguguauaucuguccauggaguuugccugaaacacucccauuggcaugauaaacguaauau

SEQ ID NO: 4203769 - RNA, 58 nt, Human herpesvirus 3
guuucguauuuaacuguucccaugucaugaucucggcuuugggaauaauugugcaaac

SEQ ID NO: 4203770 - RNA, 64 nt, Human herpesvirus 3
ucggguaacgcagguuuaaugucacuuugcauuugaacagacguguuuggacuuccguucucgg

SEQ ID NO: 4203771 - RNA, 57 nt, Human herpesvirus 3
ugcagucguauggaaacgcggcucauaagguuuucggaguguuuacgugcgauggua

SEQ ID NO: 4203772 - RNA, 84 nt, Human herpesvirus 3
ugcauuaacauuccaaguccccguucauauugcaacauaacacugucauguauugauaccacggcggcuauggguagggaugua

SEQ ID NO: 4203773 - RNA, 66 nt, Human herpesvirus 3
uguauguuggagauagagcguacuccgcguucgagugugcgguauuauguuuauauuuaauguaua

SEQ ID NO: 4203774 - RNA, 59 nt, Human herpesvirus 3
uuaccgucugguaucucauucggggacaaucguuuugaagacagggauacggaggguaa

SEQ ID NO: 4203775 - RNA, 55 nt, Human herpesvirus 3
uuagaccguuuguuaaccggagccguuauucguauuacggugcaugaggguuuaa

SEQ ID NO: 4203776 - RNA, 85 nt, Human herpesvirus 3
cacgucuaaagguguuuguugcugggugucaccguuagauuuaagugcggucaggcgggcguaggcuagcgacguaccuugcgug

SEQ ID NO: 4203777 - RNA, 55 nt, Human herpesvirus 3
ccgguacuccgggucgaggguguguacacucacgcauuuaccugguguaccacgg

SEQ ID NO: 4203778 - RNA, 84 nt, Human herpesvirus 3
cgacaccgggggaauuaucgggguucuggaucgcggcagggaaaaugauuucugucucuggcgccccgguucccccgcaagacg

SEQ ID NO: 4203779 - RNA, 63 nt, Human herpesvirus 3
gaaccgggcgcgguaguaacagagaauuucuucauaguuacaaaacuaccaugucaucguuuc

SEQ ID NO: 4203780 - RNA, 102 nt, Human herpesvirus 3
gaguaguguccaaauggcauugucgcccugaccacgagucuccgauucuauuguuaauagaauacguuuaaugucgucuuggguuaauuuggaugcuaacuc

SEQ ID NO: 4203781 - RNA, 59 nt, Human herpesvirus 3
gcuaugaucgucuaccacgcgaccaguuucaugcucguggggggcgguaugaucaaggc

SEQ ID NO: 4203782 - RNA, 64 nt, Human herpesvirus 3
ggcuguguuguuguuuccaaacggaacugugguaacgcuucuaggauucgaacgacgacaagcc

SEQ ID NO: 4203783 - RNA, 98 nt, Human herpesvirus 3
ggugcgcguaaaguaaacgggugauuuucuuccacugacaccucaaugagucuuuggccuugggguuuuggauuaagaucuccuuuaaacacgucacc

SEQ ID NO: 4203784 - RNA, 78 nt, Human herpesvirus 3
guccagccguguuacugguaauggcggcaguuauuuacgcuauggacuguuugguggacacgguauccuuuauugggc

SEQ ID NO: 4203785 - RNA, 82 nt, Human herpesvirus 3
gucucggugggaagcguuuaauuguuaugccguuauugaagauuuaacgcguaguuauguuaacgcguuacccagugaugau

SEQ ID NO: 4203786 - RNA, 77 nt, Human herpesvirus 3
uacaccuucucguuggcgucgcuguguauauacaaaaaccaagaacacaugcuucaguccguccgcggaaagaugua

SEQ ID NO: 4203787 - RNA, 81 nt, Human herpesvirus 3
uggagaggccuuauugcagacauuuguuucgaugcaaaauggguuuggggcacgaaacguguuuuuagcuaagguuuccca

SEQ ID NO: 4203788 - RNA, 56 nt, Human herpesvirus 3
uuggaacaauuccaucagagucugugcguuauacaagacgcauggaacgguucgga

SEQ ID NO: 4203789 - RNA, 77 nt, Human herpesvirus 3
cgaggcuuuggagacggcgguaaaggcuuuaucugaaaagaccgacagccuaacaucgccgguuuuacaaaguaccg

SEQ ID NO: 4203790 - RNA, 71 nt, Human herpesvirus 3
cgggggaauuaucgggguucuggaucgcggcagggaaaaugauuucugucucuggcgccccgguucccccg

SEQ ID NO: 4203791 - RNA, 59 nt, Human herpesvirus 3
gccguguuacugguaauggcggcaguuauuuacgcuauggacuguuugguggacacggu

SEQ ID NO: 4203792 - RNA, 108 nt, Human herpesvirus 3
guaccaugaguaaauuucgaaaugucauauacuguguuuuuauccauauaggcaaauguguaaauugaucgaaaucacguaauaacauacgaagaacgucauggucac

SEQ ID NO: 4203793 - RNA, 63 nt, Human herpesvirus 3
gucgccaagauuugcgguaaugcgaggauuuuuaguacucguaauucgaaugcagguggugac

SEQ ID NO: 4203794 - RNA, 55 nt, Human herpesvirus 3
gucggcgcgcugcugaugugguuacggaagacguaaaagcagaugaugugccgau

SEQ ID NO: 4203795 - RNA, 86 nt, Human herpesvirus 3
guuugccccccgacgaacguccagggacgcgagguguuauaccccgggcaucauguuuccuugggcggguaucaucggucucaaac

SEQ ID NO: 4203796 - RNA, 59 nt, Human herpesvirus 3
uucagaauaauccaggguuccugcaggguccacuggaggagccacacaauauucgcgaa

SEQ ID NO: 4203797 - RNA, 66 nt, Human herpesvirus 3
uugccuacccucuuauuggaaauauagauauuacguuuaucaugccaaugggaguguuucaggcaa

SEQ ID NO: 4203798 - RNA, 59 nt, Human herpesvirus 4 [Epstein-Barr virus]
ccuggagcguucucagggaucgcugguuuuuaaauaccaacgccgccaagacuuccagg

SEQ ID NO: 4203799 - RNA, 55 nt, Human herpesvirus 4 [Epstein-Barr virus]
cggggcaguauuuucgaccgagguccucgauguagauggccaggcgacugcuccg

SEQ ID NO: 4203800 - RNA, 84 nt, Human herpesvirus 4 [Epstein-Barr virus]
gcuuccuucgugguaaauggcagaggcgguaccgaagaaucuaugauuugauagaacuguguggcucucugcaccacaucuggc

SEQ ID NO: 4203801 - RNA, 58 nt, Human herpesvirus 4 [Epstein-Barr virus]
ugaguagagcuggguagaccugucguuguauugggaucagcaaauccaguuguauuca

SEQ ID NO: 4203802 - RNA, 71 nt, Human herpesvirus 4 [Epstein-Barr virus]
gccucugggguccaggagucugcugcggcuaugcagcccauaccuauagauccugggccccccggaggggc

SEQ ID NO: 4203803 - RNA, 64 nt, Human herpesvirus 4 [Epstein-Barr virus]
gcuguacauccagcugcuguaugccugguaacccauaggccauccggcggccaggguuugcagu

SEQ ID NO: 4203804 - RNA, 84 nt, Human herpesvirus 4 [Epstein-Barr virus]
ggaggccccgcggcaggaggccccgcggcaggaggccccgcggcaggaggccccgcggcaggaggccccgcggcaggaggcccc

SEQ ID NO: 4203805 - RNA, 69 nt, Human herpesvirus 4 [Epstein-Barr virus]
ggcaagagcuccaaagccaggcucgagaagucauagucauccucggccacacggccggagcuccgggcc

SEQ ID NO: 4203806 - RNA, 64 nt, Human herpesvirus 4 [Epstein-Barr virus]
ggcgucaggagacacggcucugucaguuaucaccguaccaugagugccauguguguccagugcc

SEQ ID NO: 4203807 - RNA, 61 nt, Human herpesvirus 4 [Epstein-Barr virus]
ggggagcucuuccgcuucaucugggcccacuacgugaggcccacgguggcggcagaccccc

SEQ ID NO: 4203808 - RNA, 97 nt, Human herpesvirus 4 [Epstein-Barr virus]
ggugaucgguguagcuguacauccagcugcuguaugccugguaacccauaggccauccggcggccaggguuugcagucuccauuuggccugaucucu

SEQ ID NO: 4203809 - RNA, 68 nt, Human herpesvirus 4 [Epstein-Barr virus]
guggugcagagagccacacaguucuaucaaaucauagauucuucgguaccgccucugccauuuaccac

SEQ ID NO: 4203810 - RNA, 62 nt, Human herpesvirus 4 [Epstein-Barr virus]
ucaccguuccucauuuugugugccuccucaaauguuccagaagucggccacaggggaggugg

SEQ ID NO: 4203811 - RNA, 71 nt, Human herpesvirus 4 [Epstein-Barr virus]
ucggugggaggcauaggccccacuccccuccuuucccugguauauuccgugggugccugugucaccgcuga

SEQ ID NO: 4203812 - RNA, 78 nt, Human herpesvirus 4 [Epstein-Barr virus]
uguuauuucauggucuuuuuacaaacucauauauuugcugagguuuugaaggaugcgauuaaggaccuuguuaugaca

SEQ ID NO: 4203813 - RNA, 61 nt, Human herpesvirus 4 [Epstein-Barr virus]
aggaugggcaggacaaggcccugguggacuaccugucggccugcacguccugccacgcccu

SEQ ID NO: 4203814 - RNA, 129 nt, Human herpesvirus 4 [Epstein-Barr virus]
caaaacaacgugugcucuuucuucauacaggcccgcaauuuccaugacagucccguugguggucagcagcagauagugaacguggagguugucaaaaucaaaguaguuggagcucaagauggaguuuug

SEQ ID NO: 4203815 - RNA, 126 nt, Human herpesvirus 4 [Epstein-Barr virus]
ccuucuggauccaggaauguugucuucaauuaauguagaccagccgcccuguugaugaauccaaccauccaggccuucgcuggcuucuaacaucccacgaacugacagguccacaacauaguaagg

SEQ ID NO: 4203816 - RNA, 129 nt, Human herpesvirus 4 [Epstein-Barr virus]
cgcacgcuggagcaugccaagaucugccagcuccugaacacggccccucucaaggccaucgugggccacggggggcgagacauguacaaggacauccuggcccaucuggagcagaacucacagcgcaag

SEQ ID NO: 4203817 - RNA, 84 nt, Human herpesvirus 4 [Epstein-Barr virus]
cuucaguuugugcuuguggaccucucagaguuucaggacgauuuaccuggaugcuggacggagauuuacaugcaggcauugaag

SEQ ID NO: 4203818 - RNA, 89 nt, Human herpesvirus 4 [Epstein-Barr virus]
gcagacguuaguaacauuuguauugugaggaaaggccuuuagauauagaggcucucccaacacaauagaauuuuugcagcuaaguuuuc

SEQ ID NO: 4203819 - RNA, 91 nt, Human herpesvirus 4 [Epstein-Barr virus]
aaggaugaccagguucccagcagcaggcgcagcgacuggcgcaacaccgucucugggccgugcugcaccucaaacauuugaucuggaccuu

SEQ ID NO: 4203820 - RNA, 76 nt, Human herpesvirus 4 [Epstein-Barr virus]
agcaccaucagcccggggggacacggagccugaccaugcaaaaaguaagccugcgcgugaccccccgccuggugcu

SEQ ID NO: 4203821 - RNA, 70 nt, Human herpesvirus 4 [Epstein-Barr virus]
cagcgagggucuccugcuacuggaccugaaccugggagucucugggacgccccuggcagacgcccuccug

SEQ ID NO: 4203822 - RNA, 74 nt, Human herpesvirus 4 [Epstein-Barr virus]
cgaguucauccugggcuuuguggcaccaaccuccgcccauccuucagaggagccacuagcacaggugagaagcg

SEQ ID NO: 4203823 - RNA, 57 nt, Human herpesvirus 4 [Epstein-Barr virus]
gaggucucugaugagcuggaagaaggcguagagcauguccagcuccgaugggaacuc

SEQ ID NO: 4203824 - RNA, 116 nt, Human herpesvirus 4 [Epstein-Barr virus]
ggaggagggggcugccacccccgggccguggaaugagggccugagucucuuuaagcugcacaaggagcugaagcgcgccccauccgaagcccgggaccucaugcagagccucuuuc

SEQ ID NO: 4203825 - RNA, 67 nt, Human herpesvirus 4 [Epstein-Barr virus]
ggauuggaagaaaugacgcuggagaagcugcacauuuuuaagcaaaaagccagcguguuucuuaucc

SEQ ID NO: 4203826 - RNA, 65 nt, Human herpesvirus 4 [Epstein-Barr virus]
gucgcugcgccugcugcugggaaccuggucauccuuugccagcgagcaguacgagugccugcgac

SEQ ID NO: 4203827 - RNA, 60 nt, Human herpesvirus 4 [Epstein-Barr virus]
uaggcauagagagugaugagcccgcuucgacagagccgguucaugaucagcuacugccug

SEQ ID NO: 4203828 - RNA, 66 nt, Human herpesvirus 4 [Epstein-Barr virus]
uauuugcggcugggcuaaugauguccgccaagaacaagccccuggacgaagcccugcucacgaaug

SEQ ID NO: 4203829 - RNA, 61 nt, Human herpesvirus 4 [Epstein-Barr virus]
ucccccgccuccagcaccgggacucguacgccgagcucgaguacgacugugaggugggcga

SEQ ID NO: 4203830 - RNA, 56 nt, Human herpesvirus 4 [Epstein-Barr virus]
uggagcuccuuggugcaggagaauuggcucuaacuaugcggucuaagaagcuucca

SEQ ID NO: 4203831 - RNA, 97 nt, Human herpesvirus 4 [Epstein-Barr virus]
uuugccucccuggagcuguacucacgggacgaacagcgugccuccaacgucuuugaccuggagggcaucuuccgggaguacaacuuccaggcgcaaa

SEQ ID NO: 4203832 - RNA, 85 nt, Human herpesvirus 4 [Epstein-Barr virus]
agcggcgcguggcauccacguuggccucaaagauccgacacccgugcuugucuugcagccacguggccacgugacacacacuguu

SEQ ID NO: 4203833 - RNA, 58 nt, Human herpesvirus 4 [Epstein-Barr virus]
aggagauuggugugaaaggagaaaaucugcuucuccccgacuuauggcuagauuuccu

SEQ ID NO: 4203834 - RNA, 67 nt, Human herpesvirus 4 [Epstein-Barr virus]
caugucagcuccacgcaaagucagauugccuucuguuaaggcuguugacaugagcauggaagacaug

SEQ ID NO: 4203835 - RNA, 96 nt, Human herpesvirus 4 [Epstein-Barr virus]
ccgagacgaaggcccgucuguagaggaagugguugcgcaugcgggccagcucccaguagaccacguccccccagacgcgcaggcacagggucucgg

SEQ ID NO: 4203836 - RNA, 64 nt, Human herpesvirus 4 [Epstein-Barr virus]
ccuggacacuggacccaggcggcgcaugaggcgcaguaccucacgccgcacgguccggcacagg

SEQ ID NO: 4203837 - RNA, 84 nt, Human herpesvirus 4 [Epstein-Barr virus]
gaacugccagcguccugaggcugcugcuuuccucggaugccaaagaagacguugagaugcguguagcccagaagcguguaguuc

SEQ ID NO: 4203838 - RNA, 58 nt, Human herpesvirus 4 [Epstein-Barr virus]
gagcuccaaagccaggcucgagaagucauagucauccucggccacacggccggagcuc

SEQ ID NO: 4203839 - RNA, 87 nt, Human herpesvirus 4 [Epstein-Barr virus]
gcgaggccccgcggcaggaggccccgcggcaggaggccccgcggcaggaggccccgcggcaggaggccccgcggcaggaggccccgc

SEQ ID NO: 4203840 - RNA, 80 nt, Human herpesvirus 4 [Epstein-Barr virus]
gcuauaaguugcuggcaaagugcugagagcaaggcaccaauuuuggcaagccuuccuuggggucguguugguggaauagc

SEQ ID NO: 4203841 - RNA, 62 nt, Human herpesvirus 4 [Epstein-Barr virus]
ggaagaaaugacgcuggagaagcugcacauuuuuaagcaaaaagccagcguguuucuuaucc

SEQ ID NO: 4203842 - RNA, 65 nt, Human herpesvirus 4 [Epstein-Barr virus]
ggagacacggcucugucaguuaucaccguaccaugagugccauguguguccagugccuaaucacc

SEQ ID NO: 4203843 - RNA, 128 nt, Human herpesvirus 4 [Epstein-Barr virus]
gucugggaggcagagggucggccuaggcccggggaaguggagggggaucgcccgggucucuguuggcagaguccgggcgauccucugagacccuccgggcccggacggucgcccucagccccccagac

SEQ ID NO: 4203844 - RNA, 91 nt, Human herpesvirus 4 [Epstein-Barr virus]
ugauaacucuaugaggacauuuucccaaucucccgccgauaccuguuccugcacaaccgagguagaugggacuucuucuuccauguuguca

SEQ ID NO: 4203845 - RNA, 57 nt, Human herpesvirus 5
accagccguagccaaucccgaugacuuuccagcgcgugggauuguugccggccaggu

SEQ ID NO: 4203846 - RNA, 57 nt, Human herpesvirus 5
acgcaggagcgucugacuagcaagcucaucgaugucaaucuaguggggcccuugugu

SEQ ID NO: 4203847 - RNA, 57 nt, Human herpesvirus 5
acgucgcgagaccugguguuugaccagcagggggaagacgcagugguccgucggugu

SEQ ID NO: 4203848 - RNA, 84 nt, Human herpesvirus 5
augcgcgcucguuaaucugaacgaaggccgcgucaacuacgccucccugcuagccuucagccaucaucccgaguuccccagcau

SEQ ID NO: 4203849 - RNA, 69 nt, Human herpesvirus 5
auuuucgccgcuucucguaaaaccuucugcuccguaacgaccggagucguuuaacgugagguugaagau

SEQ ID NO: 4203850 - RNA, 60 nt, Human herpesvirus 5
cagcucgucgcgcgcguagcucaccaccuuguccuggugcucgcaguaguggcgcagcug

SEQ ID NO: 4203851 - RNA, 75 nt, Human herpesvirus 5
ccacgcacguugaaaacaccuggaaagaacgugcccgagcgaacguccucuuuccaggugucuucaacgacgugg

SEQ ID NO: 4203852 - RNA, 64 nt, Human herpesvirus 5
ccacggccagcgccuugucgcggcccaugagguagaagggcuguucgaugugguucuggucggg

SEQ ID NO: 4203853 - RNA, 63 nt, Human herpesvirus 5
ccagcugguugaagagcgcgcacacgcgcgacacagccgucugcagcucgucggccggcgugg

SEQ ID NO: 4203854 - RNA, 99 nt, Human herpesvirus 5
ccauggucgccgcuggcggcgccgcugccgggccucggccgccgccgccacccauggcggcggggucguggcggcugugucguugugaggccuguaugg

SEQ ID NO: 4203855 - RNA, 70 nt, Human herpesvirus 5
ccgcccgugcccgucuacgcgguccacggucugcacacguuaaugcgcgagacggcguuggacgcggcgg

SEQ ID NO: 4203856 - RNA, 129 nt, Human herpesvirus 5
ccucucgccguucccgucgacugcaaaaccgccagcccucggaggcgugcucguaucccggcaaguugcgcggugggggcgugccccgcagaccccgguuaaugcgguggugguaggcccgcgagaagg

SEQ ID NO: 4203857 - RNA, 57 nt, Human herpesvirus 5
cgacgaagaugcgucgaaucgccgccgugauggugcgguucgccgucaucguugucg

SEQ ID NO: 4203858 - RNA, 59 nt, Human herpesvirus 5
cgacgcagaaccacgcgcaguuuccucacguguuaggugcuaguccgcgguucucgucg

SEQ ID NO: 4203859 - RNA, 129 nt, Human herpesvirus 5
cgaugguggcucuacaguggguggugguggcucacguuuggaugugcucggaccgugacgguggguuucgucgcgcccacgguccgggcacaaucaaccgugguccgcucugagccggcuccgccgucg

SEQ ID NO: 4203860 - RNA, 75 nt, Human herpesvirus 5
cgcaccgcccauggguuccugcugaaaacgacacucgagcagucguugcauggcggguuccgagggcgguccgcg

SEQ ID NO: 4203861 - RNA, 68 nt, Human herpesvirus 5
cgccgcugccuacgcgaucggcggccgucagcuccugcugcgugucgaugcgcuggugccaggcggug

SEQ ID NO: 4203862 - RNA, 95 nt, Human herpesvirus 5
cgccuggcgcuccaccggaaucugagacagcaacaggcgcuccgggccgugccaaaaguugcuauuguugccgcuacucggaggggcgcccggcg

SEQ ID NO: 4203863 - RNA, 85 nt, Human herpesvirus 5
cgcgcucccacgcguccucccgcccaggaccuguguagccauaaccugucaaucauccuguacgaagaggaaucucagagcagcg

SEQ ID NO: 4203864 - RNA, 71 nt, Human herpesvirus 5
cggaggaacacggcaguuagagacuggagugguggaaucauucuccuccuccgacugcgguggugccuccg

SEQ ID NO: 4203865 - RNA, 58 nt, Human herpesvirus 5
cggcacaugagcucuuucgucaguuccgauaucgacggcgaccagaagcccggugccg

SEQ ID NO: 4203866 - RNA, 122 nt, Human herpesvirus 5
cgggcguuggacgcuuaucgggcgcgcaucgccgucgaguacgugcugauucgcgccgugcgcgacgagaucuacgcuguacuacgacgggacggcggcgcguugccacagcguuucgccug

SEQ ID NO: 4203867 - RNA, 70 nt, Human herpesvirus 5
cgucguuuuuugugcuggaacuucccucgucccgacaaauguagcggaaaucuucaagcaaaucgcgacg

SEQ ID NO: 4203868 - RNA, 56 nt, Human herpesvirus 5
cguggaugagaucguagagggcgcgugguuuaagcacaccuuugcgggcauguacg

SEQ ID NO: 4203869 - RNA, 121 nt, Human herpesvirus 5
cugcaggaaacguuggcgacggaauacuuugcgcuguuacacggaauccagaccuucagcuacgggcuggacuuucggucgcaguuggaaaagauccgcgaucugcggacucguuuugcgg

SEQ ID NO: 4203870 - RNA, 58 nt, Human herpesvirus 5
gaaagccgugcugggccucaacgcggcuugugccguguacgaucaccggcuggcuuuc

SEQ ID NO: 4203871 - RNA, 62 nt, Human herpesvirus 5
gacacaacaccguaaagccguugcgcucgugggggcgcaugaaggguugcggguugcggguc

SEQ ID NO: 4203872 - RNA, 121 nt, Human herpesvirus 5
gaccgcugcgugcguccaccaccagcgaacgcacgaucucgggccaguagcagagguggacucggauagagaccucuggccagucgugcgcggggaagaugcaggccaccuccagacgguc

SEQ ID NO: 4203873 - RNA, 65 nt, Human herpesvirus 5
gacgacgugguuuuugcuuccgagcuguguuuuuauugcagcggucguuuuaaccgcaggucguc

SEQ ID NO: 4203874 - RNA, 127 nt, Human herpesvirus 5
gagcaauuuauagauucugaagugcuuuuauugcugauaacuguuguacuguauguugauguggcugucucaguacuaguggaauaguuaacgguaguacuacagggacauugacaggaacagguuu

SEQ ID NO: 4203875 - RNA, 73 nt, Human herpesvirus 5
gaggccaguaggguugcggcgucuugcgacuaagcacggcgugguccgagacacccagguuguucaugguuuc

SEQ ID NO: 4203876 - RNA, 62 nt, Human herpesvirus 5
gaggcgcugaucugcagcugcacggccguggagucgugcagccgcaugagacgugauaccuc

SEQ ID NO: 4203877 - RNA, 70 nt, Human herpesvirus 5
gaguacccauuacgugugucaugucgguuucguuuauuggaaaaagguugggagaugcgggguggugcuc

SEQ ID NO: 4203878 - RNA, 83 nt, Human herpesvirus 5
gaugcacugcgagggccagcccagcgacacgcacgagcccucgaagcgccgcaaguaacgccgcaggcccucauagucgcguc

SEQ ID NO: 4203879 - RNA, 79 nt, Human herpesvirus 5
gauuccaagucagagcagcgucggucaugacgcggcgaaacgccguugaccuggaccgaccgccgcuuuggucgggauc

SEQ ID NO: 4203880 - RNA, 108 nt, Human herpesvirus 5
gcaauaccuccuagaucacaacucccuagccagcgugccguguacguuacucacugccuguuucuacguggcuauguuugccaguuuguguuuuaucacggagauugc

SEQ ID NO: 4203881 - RNA, 61 nt, Human herpesvirus 5
gcacuugcgcguuaaguugcaauuuuccacgcacgaaauaacgguacagagcgcgaagugc

SEQ ID NO: 4203882 - RNA, 71 nt, Human herpesvirus 5
gcagaaacucgcgugccgacggggucucgcguucaccgcgaaacuccacgcccggcaccgggugugacugc

SEQ ID NO: 4203883 - RNA, 55 nt, Human herpesvirus 5
gcagggcgcuuuggcaaaaggcgcaguuuucuagugaaauguugagcgccgcugu

SEQ ID NO: 4203884 - RNA, 59 nt, Human herpesvirus 5
gcccaccggcagauagguaaagcggugggugguaaaaaccgcuuuggcuacgguggugu

SEQ ID NO: 4203885 - RNA, 66 nt, Human herpesvirus 5
gcccccaaaacugucagcggcgcucagacgucaugugcgacgccucgggcgccugugacaugaggc

SEQ ID NO: 4203886 - RNA, 82 nt, Human herpesvirus 5
gccuucccaugcgggaacuggccuggcggcggguagccgacgacucgcacgaccuaugguguugcuguauggacuggaaggc

SEQ ID NO: 4203887 - RNA, 59 nt, Human herpesvirus 5
gcgacggucuuuuuugccugggcugcgucacuucgcccagguuucuggagauuguacgc

SEQ ID NO: 4203888 - RNA, 65 nt, Human herpesvirus 5
gcgccggcagcugcagcacguggagacgcugcgucgguuucugcgcggcgacagcugcuuugugc

SEQ ID NO: 4203889 - RNA, 63 nt, Human herpesvirus 5
gcgccuggacguugcacgcggcggguaccgaaagcggcgcuaacgcggcaacggccacggcgc

SEQ ID NO: 4203890 - RNA, 55 nt, Human herpesvirus 5
gcgcgcgugugcgaucgcgugcuggaagaccacuugcauacgccgcgacgcgugc

SEQ ID NO: 4203891 - RNA, 110 nt, Human herpesvirus 5
gcgguccacaucccauucgccgucgcaacagcagcucucggugcugggcgcuuccaucgcgcuggaggaccugcugcccaugcgacuggcguccccggagacggaaccgc

SEQ ID NO: 4203892 - RNA, 55 nt, Human herpesvirus 5
gcucgucuuuuuagccgugaccaucuacuaccugguaugcuggaucaagaucagc

SEQ ID NO: 4203893 - RNA, 83 nt, Human herpesvirus 5
gcuggaagccguguaccgcgagauccucuuucguuucguggcucgccgcaacgacguggacuuuugguuacugcgcuuccagc

SEQ ID NO: 4203894 - RNA, 85 nt, Human herpesvirus 5
ggaaacuguggacgcuguuuccgaauaccgggaggagaucgugcuucccucuuccaaggaucggaaaguagcguccgucguuucc

SEQ ID NO: 4203895 - RNA, 59 nt, Human herpesvirus 5
ggaaagggcgcguucucgcccuugaggcugacgguucccaggccgagaacgcgcauucc

SEQ ID NO: 4203896 - RNA, 59 nt, Human herpesvirus 5
ggaaugcgcguucucggccugggaaccgucagccucaagggcgagaacgcgcccuuucc

SEQ ID NO: 4203897 - RNA, 65 nt, Human herpesvirus 5
ggcgcuggcggcggcgcugaucaccaccugcggggcagcccgggcgauucgccgccgccgauacc

SEQ ID NO: 4203898 - RNA, 68 nt, Human herpesvirus 5
ggcgucuguaaugauacaaaguggcggcauacgacgcauguaucugcuguagauaucauaacgcugcc

SEQ ID NO: 4203899 - RNA, 124 nt, Human herpesvirus 5
ggcugguaaggucgaucaugggcggcguggugaccguggcgguggcgggcaugacgggguuugcggcgacgggcacuccggccacagcggcggccgcggcggccacggcggcacuugccgagcc

SEQ ID NO: 4203900 - RNA, 67 nt, Human herpesvirus 5
gggcaacgcguugcgaacggugucguuaagcuuaacuuugcuuuccaccgugguguaaccgcgaucc

SEQ ID NO: 4203901 - RNA, 57 nt, Human herpesvirus 5
gggccgcgcccagguaggccguuacugucugcaggacgccguauuggugcgcgaucu

SEQ ID NO: 4203902 - RNA, 79 nt, Human herpesvirus 5
gggcgaccgucucuaccaacgcuuccugcgcgaauggcuggugugucggcaagccgagcgggaggcggugacggcgcuc

SEQ ID NO: 4203903 - RNA, 102 nt, Human herpesvirus 5
gggcucgaccggcggcugcuguugcacgggcucgggugacggcgacaucacggucacuucauccuccucgucgcccucuuccagcagccgcuggucgaaccu

SEQ ID NO: 4203904 - RNA, 65 nt, Human herpesvirus 5
ggugccccucuuucugcgucguggcuaucacggaaguggaggcggacgagguagagguuuguacc

SEQ ID NO: 4203905 - RNA, 72 nt, Human herpesvirus 5
gguggguucaugcugccuaucuacgagacggccgcgaaggccuacgccguggggcaguuugagcagcccacc

SEQ ID NO: 4203906 - RNA, 60 nt, Human herpesvirus 5
guacgccaccgauccgcacgaccgcgacgaggucgcgcguacggacgaguggaagggugc

SEQ ID NO: 4203907 - RNA, 82 nt, Human herpesvirus 5
guagagcagcauguccaccucgaaggugucggugcguacggccgugagugcgaaucccggguggaugugcgccuuggucugc

SEQ ID NO: 4203908 - RNA, 108 nt, Human herpesvirus 5
gucgcgcucggugcagaaaacgaagagguugcuguugcggcgcgagcagccgccgggcggcacgggcaagugcuucagcagcagcuucuucuugccuucggcgcguac

SEQ ID NO: 4203909 - RNA, 95 nt, Human herpesvirus 5
gugaucgcuccuuuguuggcggggcucacgguggaggcggauuucggcgucucugugcgcacgccugugcuuuguuacgacggcggggugcucac

SEQ ID NO: 4203910 - RNA, 57 nt, Human herpesvirus 5
gugcaacagcccgugucgcgcaaaaucguccaaacugugcgccagguaguaaagcac

SEQ ID NO: 4203911 - RNA, 90 nt, Human herpesvirus 5
gugcggggaggauugacgugugcggugcuuguggaacacgguguuuuaauauguauccgcguguaaugcacgcggugugcuuucuggcac

SEQ ID NO: 4203912 - RNA, 97 nt, Human herpesvirus 5
gugcuugccgcgcagcugcgccuccagccgcuccgagcgcaccuucuugaagacgcguaccucgggcgcguuggcuacgcgcacggcgcccaggcgc

SEQ ID NO: 4203913 - RNA, 66 nt, Human herpesvirus 5
gugugaccugucguuaucgcggcgaaugcgugccucugcgcacuccgggcgagaugacacguccgc

SEQ ID NO: 4203914 - RNA, 66 nt, Human herpesvirus 5
guguuugagccgcagauccgagagccucaccugcgugacggcgucuucggucucgagcaaaaacac

SEQ ID NO: 4203915 - RNA, 71 nt, Human herpesvirus 5
guuacaaguauguggaacagcucguggaccucacguugaacuaccacuacgaugcgagccacggcuuggac

SEQ ID NO: 4203916 - RNA, 55 nt, Human herpesvirus 5
uaaaaauaaagagacgggaggcugaucgcggccuucagcgucucauuugucuuua

SEQ ID NO: 4203917 - RNA, 96 nt, Human herpesvirus 5
aaagaggcucaacgagcaccaaaggcuaagucggaaaacucgcgcccgcuuccccggacgguuucggcuuagccucuggccugcgaugguuuuuuu

SEQ ID NO: 4203918 - RNA, 129 nt, Human herpesvirus 5
aaauucuuucaccaggaucccaaccgcguucuggacugcauccguccgguggugccgcgcucuacuucguaccacgagacggguguauaccagaugugggucucgggcgccaccaagaaagaccuguuu

SEQ ID NO: 4203919 - RNA, 66 nt, Human herpesvirus 5
aaguaugaaaguuggcugcgcccguuggugaauguuaccagacgcgauggcccgcuaucgcaacuu

SEQ ID NO: 4203920 - RNA, 67 nt, Human herpesvirus 5
accgcccucggaacccgccaugcaacgacugcucgagugucguuuucagcaggaacccaugggcggu

SEQ ID NO: 4203921 - RNA, 108 nt, Human herpesvirus 5
acuuggaaauccccgugagucaaaccgcuauccacgcccauugauguacugccaaaaccgcaucaccaugguaauagcgaugacuaauacguagauguacugccaagu

SEQ ID NO: 4203922 - RNA, 104 nt, Human herpesvirus 5
agagguacacgaugcccugcucuuucacuacgaacacgggcuagggcggcuguugucagugacccugccgcgucaccguguguccacucugggcucgucccucu

SEQ ID NO: 4203923 - RNA, 70 nt, Human herpesvirus 5
aguccagugaccgguaaccacguccagccccugcguauguaccaguccaagcacguccggucauuguucu

SEQ ID NO: 4203924 - RNA, 84 nt, Human herpesvirus 5
agugcaggaacuguugcagcgcuugggucagacgcuaggcgaccuagaacugcaggaaacguuggcgacggaauacuuugcgcu

SEQ ID NO: 4203925 - RNA, 83 nt, Human herpesvirus 5
aguuucuggcgcagguggguggcgcgcgggucgcgcaacagcggaucgcgcaccauaaacucgccuacgaggcguugggagcu

SEQ ID NO: 4203926 - RNA, 56 nt, Human herpesvirus 5
caacggccgcucggcgcacugcgccagccagguagaagaagcaccggcggccgcug

SEQ ID NO: 4203927 - RNA, 111 nt, Human herpesvirus 5
caacgucagcgucauauugcgcagcaggccgcgcagucguacguagccgcgggugugaucuacgaacugguguaggcccagcugguagugcuugaugagauguagacguug

SEQ ID NO: 4203928 - RNA, 71 nt, Human herpesvirus 5
cacaacaggccggcgcgcacagccuccugucgauuacgaaucggcgucagguaggcgcgcaggaacuggug

SEQ ID NO: 4203929 - RNA, 122 nt, Human herpesvirus 5
cagaaguugcgccggacggcguuguggcgcgcaggggcuccgacguggcguuauaaugaagccggggcgccacuccuacgccacgcgauuggccgucggcguccgcagucgggcgaaaucug

SEQ ID NO: 4203930 - RNA, 56 nt, Human herpesvirus 5
cagcggccgccggugcuucuucuaccuggcuggcgcagugcgccgagcggccguug

SEQ ID NO: 4203931 - RNA, 79 nt, Human herpesvirus 5
cagcguccaacacgccguccuugacgacgcagcuggccugauagcuggacacguuguuaagcggcggaaagcgaaacug

SEQ ID NO: 4203932 - RNA, 78 nt, Human herpesvirus 5
cauagccugucuaacuagccuucccgugagaguuuaugaacauguaucucaccagaaugcuaguuuguagaggcuaug

SEQ ID NO: 4203933 - RNA, 68 nt, Human herpesvirus 5
ccaccacgcggccccgcaccggcgguguuuugggugugucggggcgcggccgggugggugugugccgg

SEQ ID NO: 4203934 - RNA, 75 nt, Human herpesvirus 5
ccacgucguugaagacaccuggaaagaggacguucgcucgggcacguucuuuccagguguuuucaacgugcgugg

SEQ ID NO: 4203935 - RNA, 57 nt, Human herpesvirus 5
ccacguucaaccccauguuuuucaauguaccgcguuggaacaccaaauuguacgugg

SEQ ID NO: 4203936 - RNA, 81 nt, Human herpesvirus 5
ccauguuguccaaggguaucaugcugcguggcgcucuaaaucucagccucugucgcuuagugcucuuugucgacgacgugg

SEQ ID NO: 4203937 - RNA, 79 nt, Human herpesvirus 5
ccgcaugggaaaguacggugucgccaccguugacgugggcggcgaugagaacgucagcgguggcgaaaccgccgugcgg

SEQ ID NO: 4203938 - RNA, 85 nt, Human herpesvirus 5
ccgggcucgcccacugacucggcgcgucacaugagcgaucuggcuagccuggcgcucacggccgaguucggccugggcugucugg

SEQ ID NO: 4203939 - RNA, 74 nt, Human herpesvirus 5
ccggguccggaugcuucuuuauauaguauuggcugagcacguacugcugaaugagcaucugaaaguaauacugg

SEQ ID NO: 4203940 - RNA, 77 nt, Human herpesvirus 5
ccuggaggagccguagcggcgggaaccgcagcacucagagggugcgacauggacgccgccucugccggcuccgaggg

SEQ ID NO: 4203941 - RNA, 94 nt, Human herpesvirus 5
cgagaaagucgcagaaggucuccacgaacguguccucggugaagcgaaugcgcuucagaucguggacguguuugcgaaaccgcgacaguucucg

SEQ ID NO: 4203942 - RNA, 55 nt, Human herpesvirus 5
cgaggccgacagccuggagauguugcuggacaaguucuccacggaucaggccucg

SEQ ID NO: 4203943 - RNA, 55 nt, Human herpesvirus 5
cgcagaacaccgugcucaucacggaccagagccgcgaagaguucgauauuuugcg

SEQ ID NO: 4203944 - RNA, 57 nt, Human herpesvirus 5
cgccgcccaugugccgcguuccguacaacgaaugcggcgucgaauuaccgggcggcg

SEQ ID NO: 4203945 - RNA, 107 nt, Human herpesvirus 5
cgccgucgucgacgucgccgucgucacuucuuucgcucccucgacccagcagcgcccacagcgcgggcgagacggugcaggaguccgaggcggcggcgacggcggcg

SEQ ID NO: 4203946 - RNA, 55 nt, Human herpesvirus 5
cgcgacggccucgcugacuggaacgucguacgcugccgcggcacaggcuuucgcg

SEQ ID NO: 4203947 - RNA, 55 nt, Human herpesvirus 5
cgcucgccgucguuggaguuugacgaugacgccaaucuccucucgcucggcggcg

SEQ ID NO: 4203948 - RNA, 80 nt, Human herpesvirus 5
cgcucggcuuggucuucacguccagcagcgguaccagucccaccguuacgcaccaauccacguagagaccauagucgucg

SEQ ID NO: 4203949 - RNA, 60 nt, Human herpesvirus 5
cgcugcgcacgcucucggucacggccaacagagccaggccgggaaagagcugcgacagcg

SEQ ID NO: 4203950 - RNA, 59 nt, Human herpesvirus 5
cgcuguuggagcugcucaucgaggacuuugauaucuacguggacagcuucccacagucg

SEQ ID NO: 4203951 - RNA, 87 nt, Human herpesvirus 5
cggaaacgacggacgcuacuuuccgauccuuggaagagggaagcacgaucuccucccgguauucggaaacagcguccacaguuuccg

SEQ ID NO: 4203952 - RNA, 71 nt, Human herpesvirus 5
cggaggcaccaccgcagucggaggaggagaaugauuccaccacuccagucucuaacugccguguuccuccg

SEQ ID NO: 4203953 - RNA, 98 nt, Human herpesvirus 5
cgguagccguuucaacagcggcgugaugauacggagcgcgaagagauugagugauaggcgcacgauggccaugcgcgucaguuguuggucaauuaccg

SEQ ID NO: 4203954 - RNA, 117 nt, Human herpesvirus 5
cguaggccgucaggugcgaggccgaacggugaaucuuggcguggcgcacgcagcgaccguaguugucgcgguccgcgucgcguagcgcuucgauccacgaggucaccacguccugcg

SEQ ID NO: 4203955 - RNA, 74 nt, Human herpesvirus 5
cgucgaugcguccgccguguuucucggcguacugcugcacccagacguggccgcuaaauauggcgacgcucaug

SEQ ID NO: 4203956 - RNA, 81 nt, Human herpesvirus 5
cugcugccgccagucguaacgauucacggagcaccagccgaacguggugauccgccgaucgaugaccaaacgcgucagcgg

SEQ ID NO: 4203957 - RNA, 92 nt, Human herpesvirus 5
cuggugcuaguagggacguuugugcugcuggucauauuuguagcgucgcugaagucgaugugaagcagcaacccgaacgcgaccaggaccag

SEQ ID NO: 4203958 - RNA, 130 nt, Human herpesvirus 5
gaaaugagcggucucaaccuggucauccgcacgccgggucgcaccgagguggagccguugcucaugcugggcuccaucgagggccugcgcgccugccggccuuuugaccacaugccggccgcggacuuuc

SEQ ID NO: 4203959 - RNA, 70 nt, Human herpesvirus 5
gaagagguugcuguugcggcgcgagcagccgccgggcggcacgggcaagugcuucagcagcagcuucuuc

SEQ ID NO: 4203960 - RNA, 80 nt, Human herpesvirus 5
gacaacuuuucagagccguguuuuuugcacaauuuuuuuaaucaggaagacuauguagugggaacgcgggagggggauuc

SEQ ID NO: 4203961 - RNA, 63 nt, Human herpesvirus 5
gagacuaggucgucuuggaagccgaugcaacaacgguagaugagcagcaaaacgaccagaauc

SEQ ID NO: 4203962 - RNA, 57 nt, Human herpesvirus 5
gagaggaguggcugcuguguugucuuuauuucgcugacuucuacggaguuuucccuc

SEQ ID NO: 4203963 - RNA, 85 nt, Human herpesvirus 5
ggacggcuggagcuggaucgccagucccuggaagggacacaaaccguuccgcuucgaggcccaugguucucuggcaccggccgcc

SEQ ID NO: 4203964 - RNA, 78 nt, Human herpesvirus 5
ggcggcgugagcgcgaggcgucggagcucggggaaagcagcgcgacccggagaauggccggcgcugcgccgcgccgcc

SEQ ID NO: 4203965 - RNA, 65 nt, Human herpesvirus 5
gggucucggacgagucgacacgccgggugggacggucguggucuccucggcccgugccgggaccc

SEQ ID NO: 4203966 - RNA, 114 nt, Human herpesvirus 5
gagauucaggacgaggagccaaacugcgagcagccggagcccgcacacuggcuggaauacguggcgguccaguggcaggcccggguucgcgauucucacgaucgcuggugucuc

SEQ ID NO: 4203967 - RNA, 57 nt, Human herpesvirus 5
gaggagcgcauguucguggggucggucuuugccgcccccaacaggaucaucgaccuc

SEQ ID NO: 4203968 - RNA, 55 nt, Human herpesvirus 5
gaggaguggcugcuguguugucuuuauuucgcugacuucuacggaguuuucccuc

SEQ ID NO: 4203969 - RNA, 79 nt, Human herpesvirus 5
gaugaaccugagcaagaucaguuggcuggagcgacacugccccccguuggaccaggagcucaucauguucggggucauc

SEQ ID NO: 4203970 - RNA, 60 nt, Human herpesvirus 5
gcagcucgggcguguuuucguccucgaaagguaucggcggcggcgaaucgcccgggcugc

SEQ ID NO: 4203971 - RNA, 69 nt, Human herpesvirus 5
gcaggccagaggcuaagccgaaaccguccggggaagcgggcgcgaguuuuccgacuuagccuuuggugc

SEQ ID NO: 4203972 - RNA, 55 nt, Human herpesvirus 5
gcaggucgcggauuuguuaucgggugaaacgucacacaccgugaagacgaccugu

SEQ ID NO: 4203973 - RNA, 68 nt, Human herpesvirus 5
gcaggugguucaccacguccgugucgcgagaaaagguucgcaggucggccggggugaucuccagcugc

SEQ ID NO: 4203974 - RNA, 56 nt, Human herpesvirus 5
gcaguugcaguagagcaauuuauagauucugaagugcuuuuauugcugauaacugu

SEQ ID NO: 4203975 - RNA, 104 nt, Human herpesvirus 5
gccauggccuucgugcugugcgguggucuuuugucucuucgccucccggaggggaggagagccuacagacgggacgacacauagcgcacgaaaaagcacauggu

SEQ ID NO: 4203976 - RNA, 96 nt, Human herpesvirus 5
gcccgccggggcuucuggagaacgccggggcagcagcgaucuggggaagcugcuaaaccccugcguuuuuauaugguagcucugccgagcgcgggc

SEQ ID NO: 4203977 - RNA, 55 nt, Human herpesvirus 5
gccgaggacgccgugggcggcgaucgcgcuuuugaccgcgagcggcggacuuggc

SEQ ID NO: 4203978 - RNA, 73 nt, Human herpesvirus 5
gccgcagacuugaugugccgccgcccggauugcggcuucucuuucucaccuggaccggugguacugcuguggu

SEQ ID NO: 4203979 - RNA, 91 nt, Human herpesvirus 5
gccgcguugguccgcauggcuccggacucguuuaucgugagcuucaugauuucuacggguaucugcagcuggaccuucugggaccaguggu

SEQ ID NO: 4203980 - RNA, 58 nt, Human herpesvirus 5
gccgucugcagcucgucggccggcgugggcggcucgcggagacugggcugcaggcggc

SEQ ID NO: 4203981 - RNA, 57 nt, Human herpesvirus 5
gccgugugggaaugacggugauucuauuacacucuauaaacgguuucucauacgcgc

SEQ ID NO: 4203982 - RNA, 77 nt, Human herpesvirus 5
gccuacgauuuggccaugucguuucgcgucggcacucacaaguaugugcuggagcgcgacgacgaggccguccuggc

SEQ ID NO: 4203983 - RNA, 104 nt, Human herpesvirus 5
gcgacaaccggagcagagggucguuguccuccucguccucguggcgguuguuucuccgucgcgaucuccgagaggaggaggacgacgacgaugcagccugccgc

SEQ ID NO: 4203984 - RNA, 81 nt, Human herpesvirus 5
gcgagcaacagcagccgccgucgcuggugggcacgggcgugcaccgcggucugcucacggccacgggcugcugucugcugc

SEQ ID NO: 4203985 - RNA, 66 nt, Human herpesvirus 5
gcggcgugaccacgucaccgugccccacucgcucgcuuguguauaagagaaggguaggugcgccgc

SEQ ID NO: 4203986 - RNA, 92 nt, Human herpesvirus 5
gcgguccacaaagaacuucaacaggucguugaauugcuccgucuccauacagaugaagggccagacgccuuugagguucucggccuggccgc

SEQ ID NO: 4203987 - RNA, 90 nt, Human herpesvirus 5
gcuccugauacgcgccggcagcugcagcacguggagacgcugcgucgguuucugcgcggcgacagcugcuuugugcacgaucuccggggc

SEQ ID NO: 4203988 - RNA, 55 nt, Human herpesvirus 5
gcuguaccgccgcgucgucucguauugucagaacaaugugaagaugguggaccgc

SEQ ID NO: 4203989 - RNA, 88 nt, Human herpesvirus 5
gcuguagagcagcauguccaccucgaaggugucggugcguacggccgugagugcgaaucccggguggaugugcgccuuggucugcagc

SEQ ID NO: 4203990 - RNA, 62 nt, Human herpesvirus 5
ggcacggucucgcacgccaccugccgguaccagguguucguggacgcguacggcgccguguu

SEQ ID NO: 4203991 - RNA, 109 nt, Human herpesvirus 5
ggcgccgucguuaccgcggugcaacgcgcgcuagccgucuuugacguacuaagucgcgagaacuuggaacgccgcggcgcacagcucugucugacggaagcgacgagcc

SEQ ID NO: 4203992 - RNA, 67 nt, Human herpesvirus 5
ggcgggaggaggguggaaggggaggaggauagugguccggaucgccuucgguaucaucgucuuugcu

SEQ ID NO: 4203993 - RNA, 97 nt, Human herpesvirus 5
ggcgugcuugaggauauugcgacaguaguuggaaucaaaggaaaggcacaugcgcagcuccuugaccagcagcuugcagcgcuccugaaugcgcgcc

SEQ ID NO: 4203994 - RNA, 104 nt, Human herpesvirus 5
gggagagcgggugcgugggagaggucacucgcggcgugccgcugccgguggaaggggaagacgcgguagcaccgcggguuucgacuucuucacccuguucuucc

SEQ ID NO: 4203995 - RNA, 75 nt, Human herpesvirus 5
ggggcugacgcggaucggacaucauacugacgugaggcgcuccgucaccucucgggccgaaccccgucagcaccc

SEQ ID NO: 4203996 - RNA, 65 nt, Human herpesvirus 5
gggucccggcacgggccgaggagaccacgaccgucccacccggcgugucgacucguccgagaccc

SEQ ID NO: 4203997 - RNA, 61 nt, Human herpesvirus 5
gguucgcauuuucaguccgucuugcaagauguuaguggugaugucgcugaaauugcggauc

SEQ ID NO: 4203998 - RNA, 57 nt, Human herpesvirus 5
guaaagacaaaugagacgcugaaggccgcgaucagccucccgucucuuuauuuuuau

SEQ ID NO: 4203999 - RNA, 80 nt, Human herpesvirus 5
guaccaggauacaucgcgggaaaagagucgcuggcgaaacucggccagcagacaguguaguucuugccgaaacuuggugc

SEQ ID NO: 4204000 - RNA, 98 nt, Human herpesvirus 5
guaguaauuuucuucuugaccguuaucacggugaugccugguauauuuuccagcguuucuugugguuaaguuguagauaguuagggaggugucguugc

SEQ ID NO: 4204001 - RNA, 84 nt, Human herpesvirus 5
gucacguuuuccuuacacgguguugugucaaaaaauaagcguggugcguuugucuuugagcgcgcgacagauauagggggugau

SEQ ID NO: 4204002 - RNA, 79 nt, Human herpesvirus 5
gucacuggacucgguuucgcuguagcugugguucaaccugaacauggcucccagagcugcuaggaaccgguccagucac

SEQ ID NO: 4204003 - RNA, 81 nt, Human herpesvirus 5
gucauauagccuccggcugucaugggucugcgcuuucccaccgcgacccagcgacagaucguguuucggcggcuguucgac

SEQ ID NO: 4204004 - RNA, 66 nt, Human herpesvirus 5
gucggucucgagcgccccccgauguagggccgcucucuuacguaucccgggucgauucagacugac

SEQ ID NO: 4204005 - RNA, 76 nt, Human herpesvirus 5
gucguuuuguucaccgucgcugugcaacgcgugaaacaagagcgugaugcgcaccuucggcgguaugaagaacgau

SEQ ID NO: 4204006 - RNA, 74 nt, Human herpesvirus 5
gugaggagauguucgaugaucguauguuacaguuaugcuguaaggaagcuuuuaucgugcguccuguuuuucau

SEQ ID NO: 4204007 - RNA, 58 nt, Human herpesvirus 5
gugcucgcaguaguggcgcagcugggccgugaaaaccagcugguugaagagcgcgcac

SEQ ID NO: 4204008 - RNA, 88 nt, Human herpesvirus 5
guggcgucgacggugaacggcgcuacgucggccaacaaccacggcgaaccgccgucgccggccgacgcgcgcccgcgccucacgcugc

SEQ ID NO: 4204009 - RNA, 56 nt, Human herpesvirus 5
guggugcacguugaugcuggggauguucagcaucuugagcggcagcgcguacacau

SEQ ID NO: 4204010 - RNA, 57 nt, Human herpesvirus 5
guuucgcggcagcgcaagccgugguaaccgucgccgcuggcggcgcugccgcgagac

SEQ ID NO: 4204011 - RNA, 62 nt, Human herpesvirus 5
guuugagccgcagauccgagagccucaccugcgugacggcgucuucggucucgagcaaaaac

SEQ ID NO: 4204012 - RNA, 65 nt, Human herpesvirus 5
uaggcgcacgauggccaugcgcgucaguuguuggucaauuaccgagcgcaggauauggcagccug

SEQ ID NO: 4204013 - RNA, 56 nt, Human herpesvirus 5
ugaagcggagugcaucucgagucgcucggaaacgacucaccagacuuuuugcuuua

SEQ ID NO: 4204014 - RNA, 55 nt, Human herpesvirus 5
ugacgcgcguggccgcgcuggcucgcgacgagggucugcgcgacauuuuggguca

SEQ ID NO: 4204015 - RNA, 60 nt, Human herpesvirus 5
ugcccgggccaugcaucgccucgacgcccaaaaagcaccgagguugagccacccgccgca

SEQ ID NO: 4204016 - RNA, 79 nt, Human herpesvirus 5
uguagucccgagguggugugcgaucccuuccagucguguggagugguuugggguggcauccaaacgugagguauugaca

SEQ ID NO: 4204017 - RNA, 56 nt, Human herpesvirus 5
ugucugcucauucuggcggcgcaaaugagcuacggcgccugucuccugggcgagca

SEQ ID NO: 4204018 - RNA, 58 nt, Human herpesvirus 5
uguuguugcgggauguucaagggaccgcuggucgguuucugacugcccgaggauaaca

SEQ ID NO: 4204019 - RNA, 60 nt, Human herpesvirus 5
uugcgucuccaugauugugccgcguucgaguccugcuguuacgacaucaccgaggcggag

SEQ ID NO: 4204020 - RNA, 87 nt, Human herpesvirus 5
uuuugccggcguuuguuuucucaucaaccugucgauggaucgcuacugcgucaucguuugggguguagaauugaaccgcgugcgaaa

SEQ ID NO: 4204021 - RNA, 77 nt, Human herpesvirus 5
uuuuugcgaugucgcagccggucuagcagguuaggcuucugucccuuguccugcgugccagucuguccguccaaaga

SEQ ID NO: 4204022 - RNA, 81 nt, Human herpesvirus 5
ggaacggaggaggcuuucgccacaccuauccugaaagcguugcauucuuuaugauaggugugacgaugucuuuaccauucc

SEQ ID NO: 4204023 - RNA, 93 nt, Human herpesvirus 5
accacccgccggaacgcuguuacgauuucaaaaugugcaaucgcuucaccgucgcguacguauuuuuaugauugucugcguucuguggugcgu

SEQ ID NO: 4204024 - RNA, 101 nt, Human herpesvirus 5
acgucagcgucauauugcgcagcaggccgcgcagucguacguagccgcgggugugaucuacgaacugguguaggcccagcugguagugcuugaugagaugu

SEQ ID NO: 4204025 - RNA, 59 nt, Human herpesvirus 5
agaggaacuaucuucaucgggccggcccaagggaucgggaagaggagggugguucaucu

SEQ ID NO: 4204026 - RNA, 63 nt, Human herpesvirus 5
auacaaaccggcgacgccaaguacgguauucguaaccagcauuugaguauacgguuaauguau

SEQ ID NO: 4204027 - RNA, 65 nt, Human herpesvirus 5
cagcgcggcggcggucucugucucuggugccgcggcgcuaaccuucggggcuguugcugcuguug

SEQ ID NO: 4204028 - RNA, 76 nt, Human herpesvirus 5
ccagcagugcuccagcggcguuucgguccacguguccuggagcaguugacugagauugagaucccgggagcguugg

SEQ ID NO: 4204029 - RNA, 128 nt, Human herpesvirus 5
cccggaagguugggggcugggggcccggucaggagcuccgggagcggggucgaccgcgacggcuuccgggucucgcggcggcucccucucggcggcuccgguugggcuccccuccccccucucgaggg

SEQ ID NO: 4204030 - RNA, 77 nt, Human herpesvirus 5
ccgaugaacgcucucgucaggcuugucauggucuguaaaagcugcaugaaaaacacgacgaaagcguucaguguugg

SEQ ID NO: 4204031 - RNA, 79 nt, Human herpesvirus 5
ccgcacggcgguuucgccaccgcugacguucucaucgccgcccacgucaacgguggcgacaccguacuuucccaugcgg

SEQ ID NO: 4204032 - RNA, 83 nt, Human herpesvirus 5
ccgcauagccucuacaaacuagcauucuggugagauacauguucauaaacucucacgggaaggcuaguuagacaggcuauggg

SEQ ID NO: 4204033 - RNA, 87 nt, Human herpesvirus 5
ccgucgccgucuucuucgaaccgcacgaggaaaacgugcugcgcugccccgagcgcgugcuucggcgguugcuggaggacgcggcgg

SEQ ID NO: 4204034 - RNA, 73 nt, Human herpesvirus 5
ccguugggacggucgacguuggcugcgcacccgcuacgggaacgccagcgccugcgugacgggcacccaaugg

SEQ ID NO: 4204035 - RNA, 109 nt, Human herpesvirus 5
cgccgcugucgaacaugguaaagugcagacgcgccgccucgcccauguguacgcagccuccguugcguuccagccuggccgcgcgccguagaccguguucguagcggcg

SEQ ID NO: 4204036 - RNA, 63 nt, Human herpesvirus 5
cgcgcuauuauccaccauccgaagcuacagccgggcguuggccuguggauagauuucugcgug

SEQ ID NO: 4204037 - RNA, 65 nt, Human herpesvirus 5
cgcgggccacgucgggcugcugccgccgccacccggcccggcggcgcccgagcgggacauccgcg

SEQ ID NO: 4204038 - RNA, 79 nt, Human herpesvirus 5
cggaauacuuugcgcuguuacacggaauccagaccuucagcuacgggcuggacuuucggucgcaguuggaaaagauccg

SEQ ID NO: 4204039 - RNA, 73 nt, Human herpesvirus 5
cggcuuggucuucacguccagcagcgguaccagucccaccguuacgcaccaauccacguagagaccauagucg

SEQ ID NO: 4204040 - RNA, 121 nt, Human herpesvirus 5
cgucagguacaugucuuucgguaucaucaacgcgaacaccuccguuuugagcguguuguaaagguagccgcgcaugacgcaggugagcaacgaggugaugcccagcgagacggucuugacg

SEQ ID NO: 4204041 - RNA, 89 nt, Human herpesvirus 5
cguccgccuguacgcggaccgaucaccagaaggcggacauugggcugugguucauguuucugguuuuuggacuguguucgugguuggcg

SEQ ID NO: 4204042 - RNA, 112 nt, Human herpesvirus 5
cgucgucgucgcguggcaugggcggcggccgacggcggacgaccggcauggcgcggccgucguuuccuucgucuuccucuucaccgucucccaaggaacgcggucgacgacg

SEQ ID NO: 4204043 - RNA, 59 nt, Human herpesvirus 5
cgucuugccgucguccgucacccgggcgucgagauguucguagagaacgauggaggacg

SEQ ID NO: 4204044 - RNA, 85 nt, Human herpesvirus 5
cguugaccuaguuagauuuccuguguagaacaaugaccggacgugcuuggacugguacauacgcaggggcuggacgugguuaccg

SEQ ID NO: 4204045 - RNA, 60 nt, Human herpesvirus 5
cguuuugcgacacguguccgcgauaccuggugccguugcgggcacugggucugcacgacg

SEQ ID NO: 4204046 - RNA, 89 nt, Human herpesvirus 5
cugccuucgccguugcuguuccuccgcagaagggccgucgcgagucccgccgcugccacccagcgaggacacgcagacggcggaagcgg

SEQ ID NO: 4204047 - RNA, 75 nt, Human herpesvirus 5
cuggugucgguaggcgccuacggccgccacgcccgugcccgaggccuugcgguugguggugaaggccggguccag

SEQ ID NO: 4204048 - RNA, 73 nt, Human herpesvirus 5
gaauaaguugcgauagcgggccaucgcgucugguaacauucaccaacgggcgcagccaacuuucauacuuguc

SEQ ID NO: 4204049 - RNA, 60 nt, Human herpesvirus 5
gacaacgugguccaguacguccauccuuugcauuccgguguccagacgggaagcguuguc

SEQ ID NO: 4204050 - RNA, 67 nt, Human herpesvirus 5
gacagccuccggaucacaugguuacucagcgucugccagccuaagugacggugagauccaggcuguc

SEQ ID NO: 4204051 - RNA, 55 nt, Human herpesvirus 5
gacgaggauuccgacagcucggauggcuauccccccaaccgucaagauccgcguu

SEQ ID NO: 4204052 - RNA, 83 nt, Human herpesvirus 5
gacuuaggcacagcacgaugcccaccaccaccagugugccgcacaaggccguggcgguaggguaugugucugaaaaugagcuc

SEQ ID NO: 4204053 - RNA, 82 nt, Human herpesvirus 5
gagccaaacugcgagcagccggagcccgcacacuggcuggaauacguggcgguccaguggcaggcccggguucgcgauucuc

SEQ ID NO: 4204054 - RNA, 55 nt, Human herpesvirus 5
gagcggccagaccucgccgaaggagcccuggcccaggcgguagcucucgucgcuc

SEQ ID NO: 4204055 - RNA, 81 nt, Human herpesvirus 5
gaucucgcgcgugacgaggcgcggaccgugaguuauagccccaucguuauccaagacugcgccgcggcugucaccgacguc

SEQ ID NO: 4204056 - RNA, 73 nt, Human herpesvirus 5
gccgaggacuuuaugacgcgcguggccgcgcuggcucgcgacgagggucugcgcgacauuuugggucagcggc

SEQ ID NO: 4204057 - RNA, 103 nt, Human herpesvirus 5
gcgaggccgaacggugaaucuuggcguggcgcacgcagcgaccguaguugucgcgguccgcgucgcguagcgcuucgauccacgaggucaccacguccugcgc

SEQ ID NO: 4204058 - RNA, 56 nt, Human herpesvirus 5
gcgccggcacgaugcagcuggcccagcgccugugcgagcugcugaugugccgucgc

SEQ ID NO: 4204059 - RNA, 67 nt, Human herpesvirus 5
gcgcguuuccccguagccggccuacggcguuauugcaugucggagcugucggcgcuggguaacgugc

SEQ ID NO: 4204060 - RNA, 78 nt, Human herpesvirus 5
gcggucuguucagguggaugagggcucuucacggucgggcacucggcugugccugucauccacuuggagagcucccgc

SEQ ID NO: 4204061 - RNA, 96 nt, Human herpesvirus 5
gcgucagaucuaguagccguugcacgcgucgcggcguaugcaaguggucuuccagcacgcgaucgcacacgcgcgcguaagcgucuagguuggcgc

SEQ ID NO: 4204062 - RNA, 62 nt, Human herpesvirus 5
gcguccgccguguuucucggcguacugcugcacccagacguggccgcuaaauauggcgacgc

SEQ ID NO: 4204063 - RNA, 61 nt, Human herpesvirus 5
gcgucuucauguacgccguuuucggccucacgaggucggaggucacgccacaugaagccgc

SEQ ID NO: 4204064 - RNA, 55 nt, Human herpesvirus 5
gcgugcacgcgcugcuuucgcacgcaccugugugaucugggcagcggcugcgcgc

SEQ ID NO: 4204065 - RNA, 99 nt, Human herpesvirus 5
gcgugcguccaccaccagcgaacgcacgaucucgggccaguagcagagguggacucggauagagaccucuggccagucgugcgcggggaagaugcaggc

SEQ ID NO: 4204066 - RNA, 93 nt, Human herpesvirus 5
gcguguccagccuucccaugcgggaacuggccuggcggcggguagccgacgacucgcacgaccuaugguguugcuguauggacuggaaggcgc

SEQ ID NO: 4204067 - RNA, 65 nt, Human herpesvirus 5
gcguuccggcgggugguugacguuuaugaauucgcaacauucuucugcgcgcacccgcggcacgc

SEQ ID NO: 4204068 - RNA, 118 nt, Human herpesvirus 5
gcugcuguuucucacgcugcaccaccucgucguccacccguuucugccgcucgcgacgcuuuuccucuucgucguaauagccgacggccgccgaacgggcagcgugggcuucggcggc

SEQ ID NO: 4204069 - RNA, 59 nt, Human herpesvirus 5
gguccagcagcgugugcaguucggcgucgagacagacggcgugauugagcaccugcgcc

SEQ ID NO: 4204070 - RNA, 63 nt, Human herpesvirus 5
ggugaaacgcggaucuugacgguuggggggauagccauccgagcugucggaauccucgucgcc

SEQ ID NO: 4204071 - RNA, 73 nt, Human herpesvirus 5
guacgacggggcccucgcucgucgugccucuuccccccuccgggagaggggacgucggggcccuccgucgcac

SEQ ID NO: 4204072 - RNA, 65 nt, Human herpesvirus 5
gucaaagagaccccgcugugccgccucaaauacuaggcgguccaacugcagccgcuucucucgac

SEQ ID NO: 4204073 - RNA, 69 nt, Human herpesvirus 5
gucucuagagggaagguggggaaugucuaagcgagcgggagcgugucaucucccccaucuuuuuacaac

SEQ ID NO: 4204074 - RNA, 65 nt, Human herpesvirus 5
gucugcaggacggcgcucguuccacccaggugcaaggcguguaggaacaugaugccguugcagac

SEQ ID NO: 4204075 - RNA, 116 nt, Human herpesvirus 5
gugacgcuguuccugccuucgccguugcuguuccuccgcagaagggccgucgcgagucccgccgcugccacccagcgaggacacgcagacggcggaagcgguagacgcggcgccgc

SEQ ID NO: 4204076 - RNA, 55 nt, Human herpesvirus 5
guggcgcuucgcuacgcggugaggaaacugaugaagcgcggagccaggcugcggc

SEQ ID NO: 4204077 - RNA, 105 nt, Human herpesvirus 5
gugucaagcugguacugggucgucuguuacugggacccguggccguacccuguuuuugcgacggugaaguggagggccacggugaacaucugguaccuacgacgc

SEQ ID NO: 4204078 - RNA, 116 nt, Human herpesvirus 5
gugugacgugagucugauccaacacugaacgcuuucgucguguuuuucaugcagcuuuuacagaccaugacaagccugacgagagcguucaucggggcaugaaguacgcauuacac

SEQ ID NO: 4204079 - RNA, 66 nt, Human herpesvirus 5
guguuuuugcucgagaccgaagacgccgucacgcaggugaggcucucggaucugcggcucaaacac

SEQ ID NO: 4204080 - RNA, 59 nt, Human herpesvirus 5
guucaugcugccuaucuacgagacggccgcgaaggccuacgccguggggcaguuugagc

SEQ ID NO: 4204081 - RNA, 83 nt, Human herpesvirus 5
uauuccuuuccuguuuuguacucguaaacuguugauguuguuuuuacauccaaaagggcaaguaagaaacaggaugaggcaug

SEQ ID NO: 4204082 - RNA, 74 nt, Human herpesvirus 5
uccaagucagagcagcgucggucaugacgcggcgaaacgccguugaccuggaccgaccgccgcuuuggucggga

SEQ ID NO: 4204083 - RNA, 92 nt, Human herpesvirus 5
uccccgaauuugggcgguggcggccuuggcggucgggucugucuuuuaugaugcuccgacugucggggcgcagaaacuuuuccgucggugga

SEQ ID NO: 4204084 - RNA, 63 nt, Human herpesvirus 5
ucgaacagcgggucgcucuugauaaacacguagguggugguaaaacuucggcccgcaaucuga

SEQ ID NO: 4204085 - RNA, 94 nt, Human herpesvirus 5
ucgaccggcggcugcuguugcacgggcucgggugacggcgacaucacggucacuucauccuccucgucgcccucuuccagcagccgcuggucga

SEQ ID NO: 4204086 - RNA, 59 nt, Human herpesvirus 5
ucgccgcccgguaauucgacgccgcauucguuguacggaacgcggcacaugggcggcgg

SEQ ID NO: 4204087 - RNA, 58 nt, Human herpesvirus 5
ucgcgcucgccaggcgcuacguuguuuaagacggggucgacgaggcuggugagcgcga

SEQ ID NO: 4204088 - RNA, 57 nt, Human herpesvirus 5
ucgucacgcucaaggacaucgaggagaucaagcccucggccuacggagugcugacga

SEQ ID NO: 4204089 - RNA, 62 nt, Human herpesvirus 5
ucucacaauguggacauggccuaugccugcgacaacgcgggcguacuaccccacgucaagga

SEQ ID NO: 4204090 - RNA, 107 nt, Human herpesvirus 5
ucuugcucgacgugccgcgucuggagaacuauuuucuuugucaagucugucuuuacgagcuggacgaggacgagaugggcgaggagaugcugggcauguuggccgga

SEQ ID NO: 4204091 - RNA, 67 nt, Human herpesvirus 5
ugcgagcagccggagcccgcacacuggcuggaauacguggcgguccaguggcaggcccggguucgcg

SEQ ID NO: 4204092 - RNA, 67 nt, Human herpesvirus 5
ugcgccgguacgccgggaagguacccugcggaaacccgcucuacguacuggcccgacaagcggugca

SEQ ID NO: 4204093 - RNA, 90 nt, Human herpesvirus 5
uggcaguaucguguugugcuucaacguuaccggcggcauaguggaccgcgguauguguuaaguugguugagguaaaugaugauauaguua

SEQ ID NO: 4204094 - RNA, 79 nt, Human herpesvirus 5
ugggcauuaauauuccuuugaacgcugagccuuacagaauguuuuaguuuauuguucagcuucauaagaugucugcccg

SEQ ID NO: 4204095 - RNA, 96 nt, Human herpesvirus 5
uuugugcaccgacuccaugucucuggccggcgccagaccggacgacagcgucucguacgugagcgagucgagucauggagaugaauuuguuacaga

SEQ ID NO: 4204096 - RNA, 69 nt, Human herpesvirus 5
uagcuguuguuuuuuggugaauauaguuugguaaguccuuagcggguaaguucuaagaaacauuaguua

SEQ ID NO: 4204097 - RNA, 61 nt, Human herpesvirus 5
uccauacguuuuugggaaaguugggcucggcccaacgcaacagaccuaggcacacgaugga

SEQ ID NO: 4204098 - RNA, 55 nt, Human herpesvirus 5
ucucagugugagcacuacccuaguuucgugaaacucaacggggugcagcgcugga

SEQ ID NO: 4204099 - RNA, 77 nt, Human herpesvirus 5
ugauagaacuguuguauacgaagcaauauuguuauccaccaaagcagccacguguaucuauacauuguaguucauca

SEQ ID NO: 4204100 - RNA, 120 nt, Human herpesvirus 5
uggugugcgacgggcccccgggcucgcccacugacucggcgcgucacaugagcgaucuggcuagccuggcgcucacggccgaguucggccugggcugucuggaagcuuacgugcgcauca

SEQ ID NO: 4204101 - RNA, 79 nt, Human herpesvirus 5
ugguuuuggguuaaagcaaaaagucuggugagucguuuccgagcgacucgagaugcacuccgcuucagucuauauauca

SEQ ID NO: 4204102 - RNA, 118 nt, Human herpesvirus 5
uuccccacaguuagacggaguguaucgagcucgccggcggcgaaacaaccagcgccggguacuguggcgcagucguuuccaccaggugaacuugcucuccgcgacgaaaccggaggaa

SEQ ID NO: 4204103 - RNA, 118 nt, Human herpesvirus 5
uuccuccgguuucgucgcggagagcaaguucaccugguggaaacgacugcgccacaguacccggcgcugguuguuucgccgccggcgagcucgauacacuccgucuaacuguggggaa

SEQ ID NO: 4204104 - RNA, 76 nt, Human herpesvirus 5
uugugacguagcaauuaucguauugugcaugugucguucaucacagaguuuaguauacuaauaugaagcgucgcga

SEQ ID NO: 4204105 - RNA, 61 nt, Human herpesvirus 5
uuucugauacuggaucgucugucggccauaucuuacggccgugaucucuggcaucaugaga

SEQ ID NO: 4204106 - RNA, 67 nt, Human herpesvirus 5
uuuucgccgcuucucguaaaaccuucugcuccguaacgaccggagucguuuaacgugagguugaaga

SEQ ID NO: 4204107 - RNA, 58 nt, Human herpesvirus 5
aaacgacguagacgaugaaccguacgaaucgcggcacaacgacuggacgacgucguuu

SEQ ID NO: 4204108 - RNA, 81 nt, Human herpesvirus 5
aacguggagacgcacgacaguauacgugccguugagguagaagacaaacucgcguaaccguuguccguuauacgucacguu

SEQ ID NO: 4204109 - RNA, 111 nt, Human herpesvirus 5
aaucacgucguccagcagcuggucgcguagcuccggcauggugcugccgggccguaccugcaggaaccaguugugcggaaugccgagcgacagcaccuggucgacgugguu

SEQ ID NO: 4204110 - RNA, 62 nt, Human herpesvirus 5
accagcaguaugacgugcgaugguauuacgcccgacgugauuuacgaggucugcauguuggu

SEQ ID NO: 4204111 - RNA, 63 nt, Human herpesvirus 5
accgcugggaaaauugaaagacacgcugcguuuggcgugcugauuguaguuuuugcuauuggu

SEQ ID NO: 4204112 - RNA, 86 nt, Human herpesvirus 5
acgcgagaugaacuguuccacggccagcgccuugucgcggcccaugagguagaagggcuguucgaugugguucuggucgggcgugu

SEQ ID NO: 4204113 - RNA, 91 nt, Human herpesvirus 5
agcgccggccauucuccgggucgcgcugcuuuccccgagcuccgacgccucgcgcucacgccgccgccgcgauggagaacuggucggcgcu

SEQ ID NO: 4204114 - RNA, 57 nt, Human herpesvirus 5
aggagcggggcguccgaaggcgaggauggcauggucucgccggagcgcccggcuuuu

SEQ ID NO: 4204115 - RNA, 110 nt, Human herpesvirus 5
auaaaaacauccuccguaguggcgugcgcgaccccuagucgguugaguuccgccagcaacgaguucauggcggcuguggcgggucgcgacgacgacacuuucguuuuuau

SEQ ID NO: 4204116 - RNA, 109 nt, Human herpesvirus 5
aucacgucguccagcagcuggucgcguagcuccggcauggugcugccgggccguaccugcaggaaccaguugugcggaaugccgagcgacagcaccuggucgacguggu

SEQ ID NO: 4204117 - RNA, 72 nt, Human herpesvirus 5
auggagugagaggccggaccacuggcguuuuaaauccgagauaauugcccggucugccucuugggaauccgu

SEQ ID NO: 4204118 - RNA, 61 nt, Human herpesvirus 5
augucucccuuggagaacgucgcaccguuucgaaggcggcacuguucuccaauggauacgu

SEQ ID NO: 4204119 - RNA, 85 nt, Human herpesvirus 5
caaacccguuacaaguauguggaacagcucguggaccucacguugaacuaccacuacgaugcgagccacggcuuggacaacuuug

SEQ ID NO: 4204120 - RNA, 69 nt, Human herpesvirus 5
caacaggccggcgcgcacagccuccugucgauuacgaaucggcgucagguaggcgcgcaggaacuggug

SEQ ID NO: 4204121 - RNA, 103 nt, Human herpesvirus 5
caccacgggggcguacuuugacaacggcuggaaauggacuuuugcucucuuaguggucgcuauauuagggaucauuuucuuggccgugguguucaccguggug

SEQ ID NO: 4204122 - RNA, 90 nt, Human herpesvirus 5
cagagccguucggggcgugcggccgcgcuagcgcuucauuuucucacgucacgaaaaggagugacggacggccaguacgccacgucucug

SEQ ID NO: 4204123 - RNA, 85 nt, Human herpesvirus 5
caucacggaacaggcggcgaccgcggacucgccucggccaggggguaccgaggcggugcccgcgacucgccccuccuccaagaug

SEQ ID NO: 4204124 - RNA, 84 nt, Human herpesvirus 5
ccauuuuauacauguagggcagacguacagagcguccauggugguagaugccugugucuaggcugcucucgggaugcgagaugg

SEQ ID NO: 4204125 - RNA, 62 nt, Human herpesvirus 5
ccgacugugggaagcuguccacguagauaucaaaguccucgaugagcagcuccaacagcgug

SEQ ID NO: 4204126 - RNA, 72 nt, Human herpesvirus 5
ccgcgguuauuaucaacgucucuguguuuuuauuauuuagaaauaaauacagggaaugggaaaaacacgcgg

SEQ ID NO: 4204127 - RNA, 67 nt, Human herpesvirus 5
ccgggcguguggcgccagcgaaccggcggcguugaacgugguccuuuuguuggugccgccgcgacgg

SEQ ID NO: 4204128 - RNA, 58 nt, Human herpesvirus 5
ccugaugcuggucaugguauauaccacccucacuacgauauccguguccaccaucggg

SEQ ID NO: 4204129 - RNA, 94 nt, Human herpesvirus 5
cgacgugccgcgucuggagaacuauuuucuuugucaagucugucuuuacgagcuggacgaggacgagaugggcgaggagaugcugggcauguug

SEQ ID NO: 4204130 - RNA, 55 nt, Human herpesvirus 5
cgaggccugauccguggagaacuuguccagcaacaucuccaggcugucggccucg

SEQ ID NO: 4204131 - RNA, 55 nt, Human herpesvirus 5
cgcaaaauaucgaacucuucgcggcucugguccgugaugagcacgguguucugcg

SEQ ID NO: 4204132 - RNA, 75 nt, Human herpesvirus 5
cgccgucugcguguccucgcuggguggcagcggcgggacucgcgacggcccuucugcggaggaacagcaacggcg

SEQ ID NO: 4204133 - RNA, 75 nt, Human herpesvirus 5
cgcgagcgcaugaaacaugauccugagaacgucaucuauuucagaaaggauggcaacuuggacacgucguucgug

SEQ ID NO: 4204134 - RNA, 71 nt, Human herpesvirus 5
cgcgaguaucgggccgucgcuugccguucgacgaucuuuaguccggaggacgacagcucguguaucuuaug

SEQ ID NO: 4204135 - RNA, 64 nt, Human herpesvirus 5
cggcugcugugaaaacgggcacgguuuuauaggcauuaggacuuccccgucguacuggcggcug

SEQ ID NO: 4204136 - RNA, 103 nt, Human herpesvirus 5
cggcuguuucuaccaccgccaccaccgccgccuccucgaguauuguuccgggcccgaccccgacguccgcccgacggugguggcggcggcggcaguggagccg

SEQ ID NO: 4204137 - RNA, 89 nt, Human herpesvirus 5
cgggcgcgacgguggacucggccuuaaggcggccgcgugucauaacgcccgacgugcacgccgucgccgaggaugcugauuugcguuug

SEQ ID NO: 4204138 - RNA, 111 nt, Human herpesvirus 5
cgggcugaagaccgugcggggaggauugacgugugcggugcuuguggaacacgguguuuuaauauguauccgcguguaaugcacgcggugugcuuucuggcacucagcuug

SEQ ID NO: 4204139 - RNA, 59 nt, Human herpesvirus 5
cgguagauguccaggugcuuacgcuuaccgauccgcuuacgcacgugaggcaaucuccg

SEQ ID NO: 4204140 - RNA, 80 nt, Human herpesvirus 5
cguagaucagcagcgagccgcguaacgucugagcagccggcaguucgucgcggauguaacgcgugccguagaaagucacg

SEQ ID NO: 4204141 - RNA, 59 nt, Human herpesvirus 5
cguccgcgugucuaaaccgcgugcucgcugacgcggguuugcuuccuauauaguggacg

SEQ ID NO: 4204142 - RNA, 64 nt, Human herpesvirus 5
cgucguguagccacacggucucggucagggccucguccgagaaacggcugucggguacgugacg

SEQ ID NO: 4204143 - RNA, 67 nt, Human herpesvirus 5
cgugacgcucgauggguccgcuucaucagacugcguacgcuuuggagcgucagacccagggcgcaug

SEQ ID NO: 4204144 - RNA, 70 nt, Human herpesvirus 5
cgugccucaugucacaggcgcccgaggcgucgcacaugacgucugagcgccgcugacaguuuugggggcg

SEQ ID NO: 4204145 - RNA, 56 nt, Human herpesvirus 5
cugcgugcacggccaagacauugugcgcgaaagcgagaauucggccgugcacgugg

SEQ ID NO: 4204146 - RNA, 129 nt, Human herpesvirus 5
cuuacagucuugcgguuccgucuccggggacgccagucgcaugggcagcagguccuccagcgcgauggaagcgcccagcaccgagagcugcuguugcgacggcgaaugggauguggaccgcgaguguag

SEQ ID NO: 4204147 - RNA, 78 nt, Human herpesvirus 5
gacaagggucguagauacauguauuuguuuuccguguccugcgcgggaaucacagguaccguaucuauuauacucguc

SEQ ID NO: 4204148 - RNA, 69 nt, Human herpesvirus 5
gacguacuuguauuugcuggcaaaaaguggcgcguaccgacagucggccggcaaaauguagguggcguu

SEQ ID NO: 4204149 - RNA, 84 nt, Human herpesvirus 5
gagcaguagcggacgugucaucucgcccggagugcgcagaggcacgcauucgccgcgauaacgacaggucacacgcuguaguuc

SEQ ID NO: 4204150 - RNA, 66 nt, Human herpesvirus 5
gaggcuaccugaccguagcgguuagcuuuucuuacgaauugcugggaucguugcgguugucgccuu

SEQ ID NO: 4204151 - RNA, 64 nt, Human herpesvirus 5
gagggcauucaguugauggguggugcuacucaggaaccgcuggauacuggacuguaugcuccuu

SEQ ID NO: 4204152 - RNA, 82 nt, Human herpesvirus 5
gaucgaggccgucuuuuuucaauacgucaaggugcaauucggcuaccaccugggcgccuucuuuggacucugcggccucauc

SEQ ID NO: 4204153 - RNA, 111 nt, Human herpesvirus 5
gaugcugcugucgcucaaggucgacgcgcaucacguccuuuaagagcuguuuguugaccgacgucauagauucaacgugaugagacccgcgucguucagcgagagagcguc

SEQ ID NO: 4204154 - RNA, 61 nt, Human herpesvirus 5
gauucuggucguuuugcugcucaucuaccguuguugcaucggcuuccaagacgaccuaguc

SEQ ID NO: 4204155 - RNA, 60 nt, Human herpesvirus 5
gcaccaguucugcccucggugcauggacgccgucugguccacgcaccgagagacugaggc

SEQ ID NO: 4204156 - RNA, 96 nt, Human herpesvirus 5
gccagagggaccuucgcuuggcguucaggccuuaauacuagccgcaucuuaccugucggcagcauguaucggggcuccgacgccuuacccgccggc

SEQ ID NO: 4204157 - RNA, 57 nt, Human herpesvirus 5
gccgcggcgcucggucgacgcguuguuacuggcgaucaaguccgccgccgccgcggu

SEQ ID NO: 4204158 - RNA, 101 nt, Human herpesvirus 5
gccgcuggcgagcaacagcagccgccgucgcuggugggcacgggcgugcaccgcggucugcucacggccacgggcugcugucugcugcacaacgucacggu

SEQ ID NO: 4204159 - RNA, 64 nt, Human herpesvirus 5
gcgacauggacggcgacgugcguaccgcggcagacaucagcagcacguugcgguccgugcccgc

SEQ ID NO: 4204160 - RNA, 84 nt, Human herpesvirus 5
gcgagcccuauccggauuacaacgagcgcuguguggccgucuuucaggagacggguacggcgcgccgcauccccaacugcucgc

SEQ ID NO: 4204161 - RNA, 71 nt, Human herpesvirus 5
gcgcagcaaacagaucgcguuucagcucgugaauggcaucccgcaguucaucguaacguuguugcugcugc

SEQ ID NO: 4204162 - RNA, 59 nt, Human herpesvirus 5
gcggagcagggagcgcaaggccgagcgucguucgcgcggcgugcgcacgccgcucacgc

SEQ ID NO: 4204163 - RNA, 78 nt, Human herpesvirus 5
gcuugaagaccgcaggcgugccggcgcccauggccgccacuguggcgcgugaaucguugguacggagcguuuuugagc

SEQ ID NO: 4204164 - RNA, 80 nt, Human herpesvirus 5
ggaggcugagagucgccuguacgacgccaucaccgagaaccugaugcacugcgucaaacuggugacgacggacucgcccc

SEQ ID NO: 4204165 - RNA, 59 nt, Human herpesvirus 5
ggcacggaccgcaacgugcugcugaugucugccgcgguacgcacgucgccguccauguc

SEQ ID NO: 4204166 - RNA, 79 nt, Human herpesvirus 5
ggcagguucuuguacucaagagagcgauugguguugcggaacaugcggcucaccucgucaaucuugacgcgaccccgcc

SEQ ID NO: 4204167 - RNA, 71 nt, Human herpesvirus 5
ggccaagaucagcggcgugaugguaagcacggccaacguuaugcagaucaucaugucgcugcucucaagcc

SEQ ID NO: 4204168 - RNA, 55 nt, Human herpesvirus 5
ggcgcgcgucggccggcgacggcgguucgccgugguuguuggccgacguagcgcc

SEQ ID NO: 4204169 - RNA, 76 nt, Human herpesvirus 5
ggcgcucuggauggauugggcggacgugcguagcuguauuauuaaggcgcuaacgccucgucugagccggggugcc

SEQ ID NO: 4204170 - RNA, 119 nt, Human herpesvirus 5
ggcgcugcugcacuucggguagcugcaggccgccuagcgcuuccagcugagcuagcugcuccuguaccaaggccagugucagcgccgagccgcggcugcccgggucgcgcaccagcguc

SEQ ID NO: 4204171 - RNA, 81 nt, Human herpesvirus 5
ggcguaaaccgucgagguugaaaaaccgcguaucugcgacccguccggacuacguuguuuuucagaagcggccacaugacc

SEQ ID NO: 4204172 - RNA, 65 nt, Human herpesvirus 5
ggcgucggagccccgauacaugcugccgacagguaagaugcggcuaguauuaaggccugaacgcc

SEQ ID NO: 4204173 - RNA, 106 nt, Human herpesvirus 5
ggguccuucgguuagcggucuguucagguggaugagggcucuucacggucgggcacucggcugugccugucauccacuuggagagcucccgcgguccgauuggccc

SEQ ID NO: 4204174 - RNA, 82 nt, Human herpesvirus 5
gguaccaggauacaucgcgggaaaagagucgcuggcgaaacucggccagcagacaguguaguucuugccgaaacuuggugcc

SEQ ID NO: 4204175 - RNA, 55 nt, Human herpesvirus 5
gguacuugacgcgggugcgcgugccauagcagcucaguugucaaguccgagugcc

SEQ ID NO: 4204176 - RNA, 79 nt, Human herpesvirus 5
gguauuuuuccacugggcggccgcaccuagggagcgcgagccccgugccgggcaugggccgcggcgguggaaaauuacc

SEQ ID NO: 4204177 - RNA, 60 nt, Human herpesvirus 5
gguggggcaccacacgcgccagcgugccaauggugcgucgcagugugagguguucacacu

SEQ ID NO: 4204178 - RNA, 56 nt, Human herpesvirus 5
guacuuuccgcuguuuuccgucgucagauuuagcaacgucaagcgguuauaggugc

SEQ ID NO: 4204179 - RNA, 89 nt, Human herpesvirus 5
gucuccauguguguauaaaaagcaaggcacguucauaauguaaaaaagaacacguuguaaacaagcuauugcuguaucauucggcugac

SEQ ID NO: 4204180 - RNA, 129 nt, Human herpesvirus 5
gucuggccgagcggcgccaucuuggaggaggggcgagucgcgggcaccgccucgguacccccuggccgaggcgaguccgcggucgccgccuguuccgugaugcuaccuagagggcgcugucgaggcgac

SEQ ID NO: 4204181 - RNA, 80 nt, Human herpesvirus 5
gugacaaguaugaaaguuggcugcgcccguuggugaauguuaccagacgcgauggcccgcuaucgcaacuuauucguuac

SEQ ID NO: 4204182 - RNA, 84 nt, Human herpesvirus 5
gugcgacagcuccgccgccagcggguacacgugcccguccagcgggcaguacccgaacacggcgcccagcucguccagcagcac

SEQ ID NO: 4204183 - RNA, 64 nt, Human herpesvirus 5
guggcgguuguuucuccgucgcgaucuccgagaggaggaggacgacgacgaugcagccugccgc

SEQ ID NO: 4204184 - RNA, 77 nt, Human herpesvirus 5
guuaccggucacagagcgugcugacguggacgcacgaguguaauaccacggaaaacgguaguuuuguagccgguuac

SEQ ID NO: 4204185 - RNA, 71 nt, Human herpesvirus 5
guuucuccuccgccacucgucagcucgccggugggaguacacacgguaguaguaguuggggaggaagaggc

SEQ ID NO: 4204186 - RNA, 85 nt, Human herpesvirus 5
ucccauagccugucuaacuagccuucccgugagaguuuaugaacauguaucucaccagaaugcuaguuuguagaggcuaugcggg

SEQ ID NO: 4204187 - RNA, 65 nt, Human herpesvirus 5
ucuuccuccccaacuacuacuaccguguguacucccaccggcgagcugacgaguggcggaggaga

SEQ ID NO: 4204188 - RNA, 66 nt, Human herpesvirus 5
ugaacgcuuucgucguguuuuucaugcagcuuuuacagaccaugacaagccugacgagagcguuca

SEQ ID NO: 4204189 - RNA, 88 nt, Human herpesvirus 5
ugaacuggacgcugcgucgcagucagacccacuaccuggaggagauggccuuacagguggagauucuaaagccacgcggcguacguca

SEQ ID NO: 4204190 - RNA, 77 nt, Human herpesvirus 5
ugacguugaccguuguggggauuuuugacgggcaacacuuuuuuaccuaucacguuaauuccagcgauaaagcguca

SEQ ID NO: 4204191 - RNA, 61 nt, Human herpesvirus 5
ugaugcugugcaauaaaauuuucacaggccgcguuuuguucgauuugaugcgcuagcguca

SEQ ID NO: 4204192 - RNA, 100 nt, Human herpesvirus 5
ugucucuguggcggcgcuguccgcacagagguaacaacguguucauagcacgcuguuuuacuuuugucgggcucccagccucuguuagguugcggagaua

SEQ ID NO: 4204193 - RNA, 78 nt, Human herpesvirus 5
uguucaugcagcucgucuuuuuagccgugaccaucuacuaccugguaugcuggaucaagaucagcaugcgcaaggaca

SEQ ID NO: 4204194 - RNA, 80 nt, Human herpesvirus 6
auccgauuccguuugcguggcuagaucgagacaaaguugagcgucuuacagauuuucucagcaauuuggaaagacuggau

SEQ ID NO: 4204195 - RNA, 67 nt, Human herpesvirus 6
cccuucucuguuuggagacauacuguacuaaauccccgugguaccuuuguuuugcagagaaaaacgg

SEQ ID NO: 4204196 - RNA, 94 nt, Human herpesvirus 6
ccgcuaucuauaaucaucuccuccguuaugucuuucagaucaacaucaaguucccuggaaugaugaacgguaagcgagagauagggaugguugg

SEQ ID NO: 4204197 - RNA, 75 nt, Human herpesvirus 6
ccggcaucucuaucuacaaaauagaauuuaacgauccuuuucucacagucuuuuugcguaacguaguguugccgg

SEQ ID NO: 4204198 - RNA, 70 nt, Human herpesvirus 6
ccggcggucgaugucuggcguguugucgugcgugcuccgcgcgugugcgugcgccggacucugcugcugg

SEQ ID NO: 4204199 - RNA, 59 nt, Human herpesvirus 6
gacgugguggauaauucuucagaaacucuguuucucgguaaaaauuugguccaucaguc

SEQ ID NO: 4204200 - RNA, 88 nt, Human herpesvirus 6
gaucguaaggcaguaaagccgaugacggccuccggccccagagacgacucgcggaguggaguccaguuauuguauuuuuuuugugauu

SEQ ID NO: 4204201 - RNA, 90 nt, Human herpesvirus 6
gaugguuaaggaaaaagcgcugauuuuugagauuaaauucaaauauaaauauuuacgggauaaagaagaucacuuuguuucugaacuauu

SEQ ID NO: 4204202 - RNA, 74 nt, Human herpesvirus 6
gcaguguacaaaugauuuaauuucgcuucuuggcccuaaaguagcucagcgagucauaauucauuuuaaacugc

SEQ ID NO: 4204203 - RNA, 79 nt, Human herpesvirus 6
gcaucgguuguguuagcuuugcgauauucaaaguaaucucguugggauagcagaucgcaaaauugauacaaacgugagc

SEQ ID NO: 4204204 - RNA, 57 nt, Human herpesvirus 6
ggucgcguccgugugaacuggcacgagugagaugacuuguuuuuaucggggcggauc

SEQ ID NO: 4204205 - RNA, 72 nt, Human herpesvirus 6
gugacggugcuccgaucagggggggaaaaggucaagcgaagauaacauucuuucgugauuggaaaccgucgc

SEQ ID NO: 4204206 - RNA, 78 nt, Human herpesvirus 6
gugucugaccagguuguaccuaucgucaaauguaucgagaaauggaauguggucggugguuaguuuuuggguagacau

SEQ ID NO: 4204207 - RNA, 76 nt, Human herpesvirus 6
guuuguuggaagguaucuuucauaaguuuggcggguugccauagcugggugucgauacauauauuucucauuaaau

SEQ ID NO: 4204208 - RNA, 80 nt, Human herpesvirus 6
uaccuccggcggucgaugucuggcguguugucgugcgugcuccgcgcgugugcgugcgccggacucugcugcugggugug

SEQ ID NO: 4204209 - RNA, 99 nt, Human herpesvirus 6
ucugcaaagacauccgauuccguuugcguggcuagaucgagacaaaguugagcgucuuacagauuuucucagcaauuuggaaagacuggauaauguaga

SEQ ID NO: 4204210 - RNA, 77 nt, Human herpesvirus 6
ugugaucaagugguguuuagcuguguguuauaaggaagauucagagugaauuccuggacauggugaaacuugacaca

SEQ ID NO: 4204211 - RNA, 58 nt, Human herpesvirus 6
uuaagcagccgcgaacucguuaauaguuacuuugauguuaacucaggugguggcuugg

SEQ ID NO: 4204212 - RNA, 66 nt, Human herpesvirus 6
uuaggauucuauguggagccgucugaccugugccggugacgcuuuuuuuccacguaagauuuuuga

SEQ ID NO: 4204213 - RNA, 86 nt, Human herpesvirus 6
uucgauauugucaaagcuguuaaauguaaauggaauauuagaacaucaagaauauuuaaauacggaauagcuuuuaaauaggugaa

SEQ ID NO: 4204214 - RNA, 57 nt, Human herpesvirus 6
uugcuucguuaacaauaauacgcaguugucuggcagcuacguuuuuuuagcggguaa

SEQ ID NO: 4204215 - RNA, 121 nt, Human herpesvirus 6
uuuuggaaagcgauuaaaaauugugcguauagaugaggagggggauuugaguggaaaugucguuuugacauuuaaucacgagucuccuuuauuauuucacacuggugguggcaugacaaag

SEQ ID NO: 4204216 - RNA, 129 nt, Human herpesvirus 6
aacguuaauguuuacggauucgaucgagaaucuuccuuuucaguauagacauuuugugauuccuucggggacagugauuagaauguuugggagaacugaggacggugagaagaucugcgugaacguguu

SEQ ID NO: 4204217 - RNA, 70 nt, Human herpesvirus 6
aguaaauauuuaucugcauguauucggaccaauaagacaggucuuugcuuugccaguauaacuguuuauu

SEQ ID NO: 4204218 - RNA, 110 nt, Human herpesvirus 6
aguguauccggcucauauuugccugccgacagaugugugucuuccgaugagaguggauuguaucgagucuuuauauuuucgguguguauuuuuuaagagugggaugcauu

SEQ ID NO: 4204219 - RNA, 129 nt, Human herpesvirus 6
auguucugugcuuuuuuuauacggucagagaccacagacaaaaauaaggcaacgcccaccauaacguuuaugguuucuuguuguuuuguuuggguuaaacgccucuucuaucgugucggccggauccau

SEQ ID NO: 4204220 - RNA, 66 nt, Human herpesvirus 6
cacuccgagaacucgagccauaguuuucucagguugacaaaacuguccacagaguucuuuguugug

SEQ ID NO: 4204221 - RNA, 56 nt, Human herpesvirus 6
ccgcauucguaucgcucggcuacccguccugugucgaaaucgcggaugaauugcgg

SEQ ID NO: 4204222 - RNA, 94 nt, Human herpesvirus 6
ccgucaccucgcgcggcgucucacgccgugugugcggcgggcggcugugacuugccgacgcacgacgcggacggagaugccgaugagggaacgg

SEQ ID NO: 4204223 - RNA, 129 nt, Human herpesvirus 6
aauuauaaaauuggcccuucggggauuuuagauuuuaauguuaaauuuccaccuaaugcgcaauugaauacgaacgguguggauuuacuacaggauaaaacuucgaucgggagucccaguagcgguauu

SEQ ID NO: 4204224 - RNA, 79 nt, Human herpesvirus 6
acagaucuauuagauggcgauuugaagaaggguaauauguaaaacaguaguccauuuucaacagccugucuagaaaugu

SEQ ID NO: 4204225 - RNA, 66 nt, Human herpesvirus 6
agagcuuagucaguuuuggaauguuuuucguguuuucgaccguuucguugcaaaugacuuuguuuu

SEQ ID NO: 4204226 - RNA, 74 nt, Human herpesvirus 6
aucaaaguuuacgauggcucguccaaaggaagugguaacauuuauagguuuuggcgacuguuugaaauauugau

SEQ ID NO: 4204227 - RNA, 55 nt, Human herpesvirus 6
aucgauaauccucgggccaggguaaagcuaacguggcgcccuggcgauuuucgau

SEQ ID NO: 4204228 - RNA, 74 nt, Human herpesvirus 6
aucuagauaggugccuauugcugcuaugccugugccagaagcacggcgguugccuguauaggcagggucuaggu

SEQ ID NO: 4204229 - RNA, 56 nt, Human herpesvirus 6
caaccgcgguacccacugaucuuuaucuuuaugaagaaaaacaggaacugcgguug

SEQ ID NO: 4204230 - RNA, 78 nt, Human herpesvirus 6
cagaccgcugcuggacgaacugugcggagagggcggauggcuucccuucgcguuucucuccacaucuccgcacgucug

SEQ ID NO: 4204231 - RNA, 56 nt, Human herpesvirus 6
cggugugucauuggagaaauacgagucugacaucaucgcuccgguaugacaccccg

SEQ ID NO: 4204232 - RNA, 65 nt, Human herpesvirus 6
cgugaguauguaaauuuggcagguuacacucccgugugcaacaugcagaauaucaaaaacucaug

SEQ ID NO: 4204233 - RNA, 76 nt, Human herpesvirus 6
cuagaaccagacugggaaccgcggcagcauuccacccaguauguuuacgugguucauguuuacaaggagguuuuag

SEQ ID NO: 4204234 - RNA, 93 nt, Human herpesvirus 6
cuccguuaccuccggcggucgaugucuggcguguugucgugcgugcuccgcgcgugugcgugcgccggacucugcugcuggguguguaugggg

SEQ ID NO: 4204235 - RNA, 65 nt, Human herpesvirus 6
gacaccagcugaugugcguaauagaaccucuucagaccuuuacguagaaaaucgucaaugguguc

SEQ ID NO: 4204236 - RNA, 67 nt, Human herpesvirus 6
gauugcgaggagacggagacggaggagucgacauccggugauuccguccucgucuguuaauguaguu

SEQ ID NO: 4204237 - RNA, 61 nt, Human herpesvirus 6
gcggcggauggagcccgcucggucucgcacuuccgcgauacccagcgggcuccgucgccgc

SEQ ID NO: 4204238 - RNA, 88 nt, Human herpesvirus 6
gcguguggaccgugcucggggagggcggauaguaggagugggucgaucguuucgucccgcuggguuuuccuuguuacgguacgcgcgc

SEQ ID NO: 4204239 - RNA, 60 nt, Human herpesvirus 6
gcuuagucaguuuuggaauguuuuucguguuuucgaccguuucguugcaaaugacuuugu

SEQ ID NO: 4204240 - RNA, 120 nt, Human herpesvirus 6
ggaucagaaauaaagucuugcaguuugauguuaaugaagucugggauguagagccuggaaucugaaacgaaggcuguccauuucguaucgaaugaaaguuuuguuauaugguucugaucc

SEQ ID NO: 4204241 - RNA, 55 nt, Human herpesvirus 6
ggcaccgugccaggccaccgugggucccagacgguggcacgucgcgcgcgauguc

SEQ ID NO: 4204242 - RNA, 78 nt, Human herpesvirus 6
gggaccgagcggcggauggagcccgcucggucucgcacuuccgcgauacccagcgggcuccgucgccgcuucggaccc

SEQ ID NO: 4204243 - RNA, 58 nt, Human herpesvirus 6
gggugucuaaacgagucuggaguuuguuguuguacuucaagcucggaguuuggcaucu

SEQ ID NO: 4204244 - RNA, 68 nt, Human herpesvirus 6
ggguguuguuuagcguggagauguuugguaguucaaucgauucgguuaugaaacgcggaacgaugccu

SEQ ID NO: 4204245 - RNA, 114 nt, Human herpesvirus 6
ggugggggcgugucggaccucggguccgaagcggcgacggagcccgcuggguaucgcggaagugcgagaccgagcgggcuccauccgccgcucgguccccggcguguuccccuc

SEQ ID NO: 4204246 - RNA, 64 nt, Human herpesvirus 6
gucugcucggugggggcgcgucggcgugucuguguacguucgcgcgcguguuugcaucagugac

SEQ ID NO: 4204247 - RNA, 72 nt, Human herpesvirus 6
gucuuugaaggacuaucugagacaguccauuucuaaagauuuggaggugagacaucgagauucuuuaaagau

SEQ ID NO: 4204248 - RNA, 86 nt, Human herpesvirus 6
guuuaaguuuucacgugcacgagaucuguucgaaaaaguacuccgccucggcguacauauaaacagauuuuaugccggaaaaaaac

SEQ ID NO: 4204249 - RNA, 105 nt, Human herpesvirus 6
ucuccuuagaaauugaaccgugguuuaaaucuaauauucaucggcugaauacuuauucucaguucgcggaucaggauuuaucgaaaacgguucaauuggaggaga

SEQ ID NO: 4204250 - RNA, 80 nt, Human herpesvirus 6
ucugacauuuuccgauagggaaacucuauucaugcuagccgaaauagcgaauaucaucccuaccgaugaacgcaugcaga

SEQ ID NO: 4204251 - RNA, 99 nt, Human herpesvirus 6
ugcacacacgauaaaaugguauaguaaucauucagguuuacccgaggugacguuuuccccgaguaaaucgaacgauacuuacauuucaccgucuaggca

SEQ ID NO: 4204252 - RNA, 72 nt, Human herpesvirus 6
uggcuaggguuaugacuagggguauggcuaggguuaguacuuuggcuacgguuaggguuaguacuuuggcua

SEQ ID NO: 4204253 - RNA, 129 nt, Human herpesvirus 6
cgagaacaaaaugaggggaacacgccggggaccgagcggcggauggagcccgcucggucucgcacuuccgcgauacccagcgggcuccgucgccgcuucggacccgagguccgacacgcccccaccucg

SEQ ID NO: 4204254 - RNA, 58 nt, Human herpesvirus 6
cuagguuuaguguuagggauaguuuuaugguuaguguuaucguugguguuagaguuag

SEQ ID NO: 4204255 - RNA, 69 nt, Human herpesvirus 6
cuauauaugcaagccaugacaagaaagguauugauggaagaguaagcaacgguuauggaacguauguag

SEQ ID NO: 4204256 - RNA, 85 nt, Human herpesvirus 6
cugcagcgaugacaccagcugaugugcguaauagaaccucuucagaccuuuacguagaaaaucgucaauggugucaccgacgcgg

SEQ ID NO: 4204257 - RNA, 110 nt, Human herpesvirus 6
cuugugguggguuucaugcuuucaaauaguuguguuauaaaaggcuugaaaacggcaacugcguccuuuuuaauuucgaguauugugaaagaauuguucgaaaccgcgag

SEQ ID NO: 4204258 - RNA, 69 nt, Human herpesvirus 6
gaacaaauucgguguuuuuaauguuccgugaaaaaguuuacagcgcauucgacacauggaauuuacguc

SEQ ID NO: 4204259 - RNA, 90 nt, Human herpesvirus 6
gaacggagucucaucguaaucuuuguaggcaggaacggaaaaaccgauucucagagcuucccaacacuuuaagauaaacugacucuuuuc

SEQ ID NO: 4204260 - RNA, 78 nt, Human herpesvirus 6
gagcaguguacaaaugauuuaauuucgcuucuuggcccuaaaguagcucagcgagucauaauucauuuuaaacugcuu

SEQ ID NO: 4204261 - RNA, 55 nt, Human herpesvirus 6
gccgcagaguugcaagaaauguguaaguaucaguguuucgugucaguucuguggu

SEQ ID NO: 4204262 - RNA, 79 nt, Human herpesvirus 6
gcuaucuucggcaaaaaguuuucguuuaacaccuuuuccgagucccucauguuuucuuaacuuuuuccugacugguggu

SEQ ID NO: 4204263 - RNA, 114 nt, Human herpesvirus 6
ggagcagccagucgaagcgggcacgggcucgcgcgugggccagucucgccucguugcgccggaccgagaugcguccgcccguccucugugugugucgcgucgacauggcuuucc

SEQ ID NO: 4204264 - RNA, 60 nt, Human herpesvirus 6
ggccacacgucgugcguuuugucuucagauaugucuguaguccaaaguucauugaugucc

SEQ ID NO: 4204265 - RNA, 58 nt, Human herpesvirus 6
gggacaccuaacaauuucuuucaucuguuucaucggagaaaaguaacacaggucuccc

SEQ ID NO: 4204266 - RNA, 108 nt, Human herpesvirus 6
ggggaacacgccggggaccgagcggcggauggagcccgcucggucucgcacuuccgcgauacccagcgggcuccgucgccgcuucggacccgagguccgacacgcccc

SEQ ID NO: 4204267 - RNA, 78 nt, Human herpesvirus 6
ggguccgaagcggcgacggagcccgcuggguaucgcggaagugcgagaccgagcgggcuccauccgccgcucgguccc

SEQ ID NO: 4204268 - RNA, 89 nt, Human herpesvirus 6
gggugcucauggaucaggucggcaggguguacgcggccagucucgacgggggagccguggugcgucucuccgauaguuucagggcguuu

SEQ ID NO: 4204269 - RNA, 67 nt, Human herpesvirus 6
gguaaaauggcugugcuaucugauuuuggucugggguguggaaaaaagucaccuguauagauuuauu

SEQ ID NO: 4204270 - RNA, 72 nt, Human herpesvirus 6
ggucaugaucugcuugauauuuuccgagaugagguugagaaugauuuuaagucguugugucaugauuaugcc

SEQ ID NO: 4204271 - RNA, 80 nt, Human herpesvirus 6
guaguccaugaugcucugauguagauauuuuaaaaauagguaaucuuguuuggaagcugccaucaguucacauaggagac

SEQ ID NO: 4204272 - RNA, 130 nt, Human herpesvirus 6
uagauugugagguguuugaagucgaagucguuaauaucguauuuagaauuaaggaauugguauuuaggauacuuuuuccguauuuuuagucgcgaugagguuaugacgaugguuucguuugcauaguuua

SEQ ID NO: 4204273 - RNA, 68 nt, Human herpesvirus 6
uccaccgaggugugauuuuagaagguagaguuugaacacuacgugucucagucgcacacgguacagga

SEQ ID NO: 4204274 - RNA, 96 nt, Human herpesvirus 6
uccgucaccucgcgcggcgucucacgccgugugugcggcgggcggcugugacuugccgacgcacgacgcggacggagaugccgaugagggaacgga

SEQ ID NO: 4204275 - RNA, 96 nt, Human herpesvirus 6
uccguucccucaucggcaucuccguccgcgucgugcgucggcaagucacagccgcccgccgcacacacggcgugagacgccgcgcgaggugacgga

SEQ ID NO: 4204276 - RNA, 80 nt, Human herpesvirus 6
uguaaauacuaaauguuaugaagaaguuaacuauggaguccuugucaguuuauaucuucguaaugggagucugcuuuaca

SEQ ID NO: 4204277 - RNA, 56 nt, Human herpesvirus 6
uguggaaaaaaacgcugguggguagguuguuuuccauggugucguuuaauuucaca

SEQ ID NO: 4204278 - RNA, 64 nt, Human herpesvirus 6
uuguguuagcuuugcgauauucaaaguaaucucguugggauagcagaucgcaaaauugauacaa

SEQ ID NO: 4204279 - RNA, 75 nt, Human herpesvirus 6
uuuucacgugcacgagaucuguucgaaaaaguacuccgccucggcguacauauaaacagauuuuaugccggaaaa

SEQ ID NO: 4204280 - RNA, 91 nt, Human herpesvirus 6
aaggagaucuauggcgacgcggcgucuccgacgagugugcucuugaaacacuuuuuguccgaucacaucuuugucgcguacgcuucuucuu

SEQ ID NO: 4204281 - RNA, 56 nt, Human herpesvirus 6
aaucuggguuccugcuuaguuacauguucccaaagacuuagcagauauucuagauu

SEQ ID NO: 4204282 - RNA, 90 nt, Human herpesvirus 6
agccggaaaaagauguucgccguuuacuauuguaaaauccacaagggaauauaaacauguauuguaaaucgccacgucaaaaaccgugcu

SEQ ID NO: 4204283 - RNA, 85 nt, Human herpesvirus 6
aucggaaauggcuaauaauuccauaaaugucaaggagucgaauguuuauggccaugugggguguguuaaugacgccauuuccgau

SEQ ID NO: 4204284 - RNA, 119 nt, Human herpesvirus 6
auguuuacggauucgaucgagaaucuuccuuuucaguauagacauuuugugauuccuucggggacagugauuagaauguuugggagaacugaggacggugagaagaucugcgugaacgu

SEQ ID NO: 4204285 - RNA, 130 nt, Human herpesvirus 6
cacacacgccgacuccguccgcagaggcggcgaccgcagcggcagcggaaacuguaacggccacguucuccgaacagcgacaguaacggcggcggcggcgguugucgccgucacgguagucguggcggag

SEQ ID NO: 4204286 - RNA, 67 nt, Human herpesvirus 6
ccgaauuaaacgcuuguuucacguuugguauaaaugccaauuuugagcaauauaagauagaauuugg

SEQ ID NO: 4204287 - RNA, 70 nt, Human herpesvirus 6
cgguuguguuagcuuugcgauauucaaaguaaucucguugggauagcagaucgcaaaauugauacaaacg

SEQ ID NO: 4204288 - RNA, 74 nt, Human herpesvirus 6
gacgauucucauuauaacgcagacauccaauuuuuaaaaaaucggacauguugcgagcuaugaagagaaggcuc

SEQ ID NO: 4204289 - RNA, 72 nt, Human herpesvirus 6
gacguuuugaauucucauuugaaagcgauagaggaugcuuugcuguuuacgaaugauggggagguaaacguc

SEQ ID NO: 4204290 - RNA, 64 nt, Human herpesvirus 6
uuagauggcgauuugaagaaggguaauauguaaaacaguaguccauuuucaacagccugucuag

SEQ ID NO: 4204291 - RNA, 61 nt, Human herpesvirus 6
uucggacuucauguuaugaauacgcgcacuuuuccgcggagguucauuucugacgucugaa

SEQ ID NO: 4204292 - RNA, 75 nt, Human herpesvirus 6
uugguggugauugcugagacugaaugggacgucgauggguucuuuaccgguaauuggcaguuuuaugaucgcuag

SEQ ID NO: 4204293 - RNA, 116 nt, Human herpesvirus 6
gaggugggggcgugucggaccucggguccgaagcggcgacggagcccgcuggguaucgcggaagugcgagaccgagcgggcuccauccgccgcucgguccccggcguguuccccuc

SEQ ID NO: 4204294 - RNA, 66 nt, Human herpesvirus 6
gauugauaaguuuccgacaugcccaacgucgacauccguccgaagcgcauggagauuuuuccaauc

SEQ ID NO: 4204295 - RNA, 87 nt, Human herpesvirus 6
gccggggaccgagcggcggauggagcccgcucggucucgcacuuccgcgauacccagcgggcuccgucgccgcuucggacccgaggu

SEQ ID NO: 4204296 - RNA, 57 nt, Human herpesvirus 6
gcgagcauaguuuaguggguauuuguacggcacgaacggcaccauuaauauguucgc

SEQ ID NO: 4204297 - RNA, 129 nt, Human herpesvirus 6
gggacgugcacgggcuccguuaccuccggcggucgaugucuggcguguugucgugcgugcuccgcgcgugugcgugcgccggacucugcugcuggguguguaugggggcgauaugcggagguugucagc

SEQ ID NO: 4204298 - RNA, 108 nt, Human herpesvirus 6
gucgccuccgucaccucgcgcggcgucucacgccgugugugcggcgggcggcugugacuugccgacgcacgacgcggacggagaugccgaugagggaacggacgugac

SEQ ID NO: 4204299 - RNA, 68 nt, Human herpesvirus 6
gucgcucaugcggacagucaaacauucauuaacacgcaggauguugcauucucucacagcaugaugac

SEQ ID NO: 4204300 - RNA, 65 nt, Human herpesvirus 6
gucugccuauaucgaauuaucuuugaagccuuuguaggucucggguuuaguucgauuauguugac

SEQ ID NO: 4204301 - RNA, 60 nt, Human herpesvirus 6
uaucagaugacgcaucaacuuuacauaaaccccgugcagauuauaugcuacguacugaua

SEQ ID NO: 4204302 - RNA, 82 nt, Human herpesvirus 6
uccuccucucaggccuccggcuuccucuccgucccccgagcgggagcggcgaggcggccggagagccgggguacgaggagga

SEQ ID NO: 4204303 - RNA, 105 nt, Human herpesvirus 6
ugaguggacgcugacauucuaguaugcuuuaccucuuuagugacuucagugauugaguaugaugaauuacuagaugguaaagcguuguuaguuauguguacuuca

SEQ ID NO: 4204304 - RNA, 80 nt, Human herpesvirus 6
uugggaaacugauacuguucaaguccuugaguuuacagauacacaugagggagaugaggaguauuuuaaagauuuucuaa

SEQ ID NO: 4204305 - RNA, 129 nt, Human herpesvirus 6B
aaacugaaaucgugcacagauacuacuacugacauuucugaagaugaucuccuuuugugugcggccaggaggucgagugacaucuuacaaauaaugcaauuaguguuuacggugcaugugcaauuuuuu

SEQ ID NO: 4204306 - RNA, 86 nt, Human herpesvirus 6B
aggccgggcguauaggaaggguggcgcgucgcgaagucccgccucauagguggggcauucgaggccgcccucuauacuuucgguuu

SEQ ID NO: 4204307 - RNA, 94 nt, Human herpesvirus 6B
ccacugucgucaagacgccuaguguuaaagaugcugacgggggcacaucuguugcgguuucggaaaaagaggaggguauggcugacgucagugg

SEQ ID NO: 4204308 - RNA, 95 nt, Human herpesvirus 6B
cccacggcuuugcucggagucccggagaucuaaugggggagaugaacggagaucugggagacgagggagagacgggagagggcggagacaacggg

SEQ ID NO: 4204309 - RNA, 55 nt, Human herpesvirus 6B
ccgguuuauuucagcucuuuguuuguuuacauucaguuggccaaaggagggccgg

SEQ ID NO: 4204310 - RNA, 72 nt, Human herpesvirus 6B
gacguuuugaauucucauuuaaaagcgauagaggaugcuuugcuguuuacgaaugauggggagguaaacguc

SEQ ID NO: 4204311 - RNA, 96 nt, Human herpesvirus 6B
gcucucccucuucccucuuccuucucguaccccggcuuucucgccgccucgccgcucccgcucgggggacggagaggaagccggagcccugagagc

SEQ ID NO: 4204312 - RNA, 66 nt, Human herpesvirus 6B
gggaucuugaugcguauucucacucaaugguugucuaugugugacguccgcaucaugguauagucc

SEQ ID NO: 4204313 - RNA, 106 nt, Human herpesvirus 6B
gguaauaucccucguuguuugguuaacguuagauguuuuguuagaggagaacacuuuugcacagcagacaauguaauaaauaauaaucaggaggaauaagauagcc

SEQ ID NO: 4204314 - RNA, 97 nt, Human herpesvirus 6B
ucgccccgaaaccgcaacgcggcagagucggcgccacacccccgucccccgaguucgcgaugggcuggcgccgacccugccgcggcaacgaaggcga

SEQ ID NO: 4204315 - RNA, 74 nt, Human herpesvirus 6B
ugaugucgcucgugugaacuuugugcacguuuucugauucgauaggaagugcgggaguuucgccgaguuuguca

SEQ ID NO: 4204316 - RNA, 72 nt, Human herpesvirus 6B
ugcacuugucauuucggaagguagcgucagauucgauauauaaugucuuugaaggacuaucugagacaguca

SEQ ID NO: 4204317 - RNA, 74 nt, Human herpesvirus 6B
ugugugugacuguguacauucgccgauuuuauuucucaucggguuaaaggcagggagggauacggucacgcgca

SEQ ID NO: 4204318 - RNA, 65 nt, Human herpesvirus 6B
uguugaaagaguuguauauggugauguguucucgaaggagcaucgguuguguuagcuucgcgaua

SEQ ID NO: 4204319 - RNA, 66 nt, Human herpesvirus 6B
uuguucgcuuuugcaaucugagcaugacuggguuuucuaguaaacauuugauucaguggcggagga

SEQ ID NO: 4204320 - RNA, 79 nt, Human herpesvirus 6B
aaauaguugugaaaauggcugaauaauauuagaguccucuauuucuguuuuauuuguauuuucauuggaaaaacuguuu

SEQ ID NO: 4204321 - RNA, 84 nt, Human herpesvirus 6B
aacagcauucagaccuuagcggccaacuuagauuguaucguuacugcaacgacaucuaucgccgcucagaauuugagcguuguu

SEQ ID NO: 4204322 - RNA, 82 nt, Human herpesvirus 6B
aauguccgcagucucuugcggggcuucuaccguaguccguagggacugcgaggacacguugcgcgacggagaugcgggaguu

SEQ ID NO: 4204323 - RNA, 56 nt, Human herpesvirus 6B
aggguggcgcgucgcgaagucccgccucauagguggggcauucgaggccgcccucu

SEQ ID NO: 4204324 - RNA, 64 nt, Human herpesvirus 6B
aguugcauggugauguguuagcuaucucgaaaugcauagaaguuaaucaaucauccguucagcu

SEQ ID NO: 4204325 - RNA, 55 nt, Human herpesvirus 6B
cccauguaugcauuaacucugggugaguuuuaucacuuucacacgcauagauggg

SEQ ID NO: 4204326 - RNA, 93 nt, Human herpesvirus 6B
cuggcguguggaccgugcccagggaggacggauagcaggagucggucgaucgucucgcuccgcuugguuuuccgugucacggcgcgcgcauag

SEQ ID NO: 4204327 - RNA, 100 nt, Human herpesvirus 6B
cuuuuaaugcgguuuuuacgaacucaacuuucaauaagauuccuuugacgacgauaagucggcuuuuuguucaguugauuauaggaggacacgcuaaagg

SEQ ID NO: 4204328 - RNA, 78 nt, Human herpesvirus 6B
gagcaguguacaaaugauuuaauuucgcuucuugguccuaaaguagcucagcgagucauaauucauuuuaaacugcuu

SEQ ID NO: 4204329 - RNA, 62 nt, Human herpesvirus 6B
gagugaccucugguggugaauauagagacuugcuaaaugguguauucucauuaguguuauuc

SEQ ID NO: 4204330 - RNA, 76 nt, Human herpesvirus 6B
gauauucacuguaguucauggauuaccaaugucccacgaggcauuugguuggcaaacacugagcuacaagauuauc

SEQ ID NO: 4204331 - RNA, 73 nt, Human herpesvirus 6B
gcaacgcggcagagucggcgccacacccccgucccccgaguucgcgaugggcuggcgccgacccugccgcggc

SEQ ID NO: 4204332 - RNA, 57 nt, Human herpesvirus 6B
guaaccgcgguacacacugaccuuuaacuuuaugagaaaaacaggaacugcgguugc

SEQ ID NO: 4204333 - RNA, 62 nt, Human herpesvirus 6B
guuuucuucuuuuguuuugcauucguccggcaaacuguaaucguaauacaacagaagcaaau

SEQ ID NO: 4204334 - RNA, 70 nt, Human herpesvirus 6B
uagguggguguggaguauggugucugaaaaaugguggcgaucuguauaucuaugcuuuuguacucgcuua

SEQ ID NO: 4204335 - RNA, 65 nt, Human herpesvirus 6B
ucagaguaugaauucguuacaaucucuguguguguugugcgcuaggcuuaaugaaugugcuuugg

SEQ ID NO: 4204336 - RNA, 106 nt, Human herpesvirus 6B
ugguacuucucacuucgauauugucaaagcuguuaaauguaaauggaauauuagaacaucaagaauauuuaaauacggaauagcuuuuaaauaggugaaauggcua

SEQ ID NO: 4204337 - RNA, 64 nt, Human herpesvirus 6B
uuauugaaaugggauaugauguguuuucgauguauuucaucgcauacgucucccaguucguuaa

SEQ ID NO: 4204338 - RNA, 68 nt, Human herpesvirus 6B
uugaaacggagggcggaaagcgagucuugugugaaaguauuguacuucauuuugcguuuauguuucaa

SEQ ID NO: 4204339 - RNA, 60 nt, Human herpesvirus 6B
uugcgcgacggagaugcgggaguugacacuucgugaucccgcccucgucuguugcuguag

SEQ ID NO: 4204340 - RNA, 58 nt, Human herpesvirus 6B
accgguaauugugaaacuuuaauaguuaauucauguuuugguuccacuugugcacggu

SEQ ID NO: 4204341 - RNA, 100 nt, Human herpesvirus 6B
augcaaauagcacucacggcacuuuauagaaaaugucucacgauaaugcacaccaauuuucugaauguuuucauguaauuuaauaaacauuuauuuguau

SEQ ID NO: 4204342 - RNA, 93 nt, Human herpesvirus 6B
ccaugugugagcguuaagaauuggugucauucgugguauuucugugugguugaucucuccgugaguggacgccgacauucuauuuugcuuugg

SEQ ID NO: 4204343 - RNA, 92 nt, Human herpesvirus 6B
ccugcuccugcucucagggcuccggcuuccucuccgucccccgagcgggagcggcgaggcggcgagaaagccgggguacgagaaggaagagg

SEQ ID NO: 4204344 - RNA, 67 nt, Human herpesvirus 6B
gacguccgucgaacaacgcguuggcgaaauucaccagagguucgccgcaaaguugcucguugauguu

SEQ ID NO: 4204345 - RNA, 116 nt, Human herpesvirus 6B
gagguccugcuggaggcucugcuggaggcucugcuggaggcucugcuggaggcucugcuggaggcucugcuggaggcucugcuggaggcucugcuggaggcucugucagagaccuc

SEQ ID NO: 4204346 - RNA, 61 nt, Human herpesvirus 6B
gaguggccaagcguccccggggagaugucuacccggggccgaauacguccaauguccucuc

SEQ ID NO: 4204347 - RNA, 106 nt, Human herpesvirus 6B
gcacauugugugugacuguguacauucgccgauuuuauuucucaucggguuaaaggcagggagggauacggucacgcgcacauauacacaccccacacauacacgc

SEQ ID NO: 4204348 - RNA, 64 nt, Human herpesvirus 6B
gcuuucaagcagucccgaucuaugcgacucaccgugucgcguuggcaucgggcgcugcuauagc

SEQ ID NO: 4204349 - RNA, 85 nt, Human herpesvirus 6B
gggacuugauauauccgagugucguuuuuuguauaaaaguuaaaaguuauaaagcccgggcgaacaauuggauuuucagaguuuc

SEQ ID NO: 4204350 - RNA, 77 nt, Human herpesvirus 6B
gggcggcuggcuucccuuugcguuucucacggcaucuccgcacgucugucugauccuaacggagggaggccccgucc

SEQ ID NO: 4204351 - RNA, 58 nt, Human herpesvirus 6B
gggugucuaaaugagucuggaguuuguuguuguacuucaaauucggaguuuggcaucu

SEQ ID NO: 4204352 - RNA, 73 nt, Human herpesvirus 6B
ugggugcaguggcuaagaaggcugucaguucuucgggagauguaaugacggcuguuuuugcucucuguaucca

SEQ ID NO: 4204353 - RNA, 64 nt, Human herpesvirus 6B
uguaagugucguucuaucuacucggggaaaaugucaccacggguaaacuugaaugauuaauaca

SEQ ID NO: 4204354 - RNA, 77 nt, Human herpesvirus 6B
uuuaaguugcaaaacgaucucgauucugugcagucuccguuuaggcugccaaaugcugaucugucucgcgauuuaga

SEQ ID NO: 4204355 - RNA, 58 nt, Human herpesvirus 6B
uuucggaugucuacgagagcaugccguaucacgggcauguuauugggagcauuggaaa

SEQ ID NO: 4204356 - RNA, 85 nt, Human herpesvirus 6B
aaaacgggccaagauaucuacagauggaaacguuuauaucggauuuauuccgguaugaaugucaucgagauaaucguuauguuuu

SEQ ID NO: 4204357 - RNA, 62 nt, Human herpesvirus 6B
agaccgcauucguaucgcucggcuacacguucugugucgaaaucgcggaugaauugcgguuu

SEQ ID NO: 4204358 - RNA, 99 nt, Human herpesvirus 6B
aggcagcuaaaauccgaaacucuuccaaauuguguuuuuuugaucugaagguucuuugaaucuauuuugagaaaaguuacuugugaaaacuguugcgcu

SEQ ID NO: 4204359 - RNA, 84 nt, Human herpesvirus 6B
cagugaaagagugcucgauuccagaaucucuaaagaauauauuuaaagaacuggaaagaagcaucccgaauuuuucccccccug

SEQ ID NO: 4204360 - RNA, 85 nt, Human herpesvirus 6B
cccaauuuugguacaauuuuuacaagucgaucuuugguuacauuugguuugacauuagagaaauuugugagcuuggcuaauaggg

SEQ ID NO: 4204361 - RNA, 71 nt, Human herpesvirus 6B
gaaguuuaccuagagauuacaagguacacaauacacaguagaccgaguaucacguaucucugguaaauguc

SEQ ID NO: 4204362 - RNA, 69 nt, Human herpesvirus 6B
gaaucugaagcguuuucacgaugugugucaauacccugcucccaauaucucgcaaauaccgaucaguuc

SEQ ID NO: 4204363 - RNA, 64 nt, Human herpesvirus 6B
gaguauuggacucacuccuguuccucagcauaaggaacugcaggaagagggaguccaacaacuc

SEQ ID NO: 4204364 - RNA, 70 nt, Human herpesvirus 6B
gccggccucugcugcuggguguguaugggggugauaugcggugacugucagcggugguggcggaggcggu

SEQ ID NO: 4204365 - RNA, 67 nt, Human herpesvirus 6B
gcgugugggauuugccagacuuuuugcggacugcgguuaugagaagauuggaaaaauauccaugcgc

SEQ ID NO: 4204366 - RNA, 71 nt, Human herpesvirus 6B
ggaugacaccggcuauaaaagccgaaaugacacucucgucuucguuggccgucuuuauggccacuuuaucu

SEQ ID NO: 4204367 - RNA, 62 nt, Human herpesvirus 6B
uaaauucgguguuuuugauguuccgugaaaaaguuuacagcgcauucgacauauggaauuua

SEQ ID NO: 4204368 - RNA, 73 nt, Human herpesvirus 6B
uaaguugcaaaacgaucucgauucugugcagucuccguuuaggcugccaaaugcugaucugucucgcgauuua

SEQ ID NO: 4204369 - RNA, 69 nt, Human herpesvirus 6B
ucugggaucccgcucggagcucucucaccccguguuggagugggagagaacagagcugguccugacgga

SEQ ID NO: 4204370 - RNA, 64 nt, Human herpesvirus 6B
ugguuuuauaagcucaagaggguuuuuuacaaugagccuggcuuaagaagggcuuuaaaaauua

SEQ ID NO: 4204371 - RNA, 64 nt, Human herpesvirus 6B; identical to SEQ ID NO: 4204290

SEQ ID NO: 4204372 - RNA, 61 nt, Human herpesvirus 6B
uuugcucggagucccggagaucuaaugggggagaugaacggagaucugggagacgagggag

SEQ ID NO: 4204373 - RNA, 99 nt, Human herpesvirus 7
acagucaccaagggcguagaggcagaccuaaacccagagcuaaaacauggagcgaagcuuuaucccaccgguccuuccucaacauuuacgcguggcugu

SEQ ID NO: 4204374 - RNA, 74 nt, Human herpesvirus 7
acugaacaacggaguaacaacacgcuauccaaagauuuauuuguaggcucugaagauggguuguuauccucggu

SEQ ID NO: 4204375 - RNA, 58 nt, Human herpesvirus 7
agaguuucgaauccuuuuaagcuugcuggcaacgucaucuugcggauauugaaaaucu

SEQ ID NO: 4204376 - RNA, 68 nt, Human herpesvirus 7
agauguacaucguuuuccugcgaaugugaauggccagacgaagcacaguaaguaaaaaugguuacacu

SEQ ID NO: 4204377 - RNA, 103 nt, Human herpesvirus 7
agauuuagagauauagaugucauaaauuuuaguugccgugaugcaauuuuuucgcauagcgugccagaguggauuuguugacuguccucuugucucucguucu

SEQ ID NO: 4204378 - RNA, 119 nt, Human herpesvirus 7
auaacgggauaggaaucauagagauauuuuggguaauaugucuuuagaauacuugcccccuguuagaagacguauuggucaauauaaucauuugagaaucuacaaaaaaauucuguugu

SEQ ID NO: 4204379 - RNA, 55 nt, Human herpesvirus 7
auuugaagaacaagaggcacuguuugaaaaaguaguuguuuuagguuuuuuaaau

SEQ ID NO: 4204380 - RNA, 80 nt, Human herpesvirus 7
caaaaauuuaauagucauuuucaaauagaguuuaauuguacucacuuaauuucugguauggaauuggcgagggauuuuug

SEQ ID NO: 4204381 - RNA, 129 nt, Human herpesvirus 7
cuggucugugcauaguuugaucaguuaaaucaaguauuucagucuguaguauucugugcauuuuuuuagaauuguuuauagacguggaauuucuuggcucguccaauaucauggaauccuuuuuuaccg

SEQ ID NO: 4204382 - RNA, 69 nt, Human herpesvirus 7
gacuagaaaagaagcuaugaugccugugaaugucaacagcaaacacaggaaaaauaguggugucuacuc

SEQ ID NO: 4204383 - RNA, 71 nt, Human herpesvirus 7
gagaaaaggucuguaccauauggaauugucauggaaggaaaauuaagacaguuuauggacaauuuuggcuc

SEQ ID NO: 4204384 - RNA, 66 nt, Human herpesvirus 7
gauagggaucguggugaaguuccaggcuccaguuaggcggccauggcaaugcuacgaguucuccuc

SEQ ID NO: 4204385 - RNA, 68 nt, Human herpesvirus 7
gauccuucuugagaugcccaaggauuuguuguugccacaaaagcaucgcuaucaacucgagaaugauc

SEQ ID NO: 4204386 - RNA, 77 nt, Human herpesvirus 7
gcuauguuugucauguaaguauugguuugcucauuagaaaauagaaucaucaaugcuucaucgaaucgucgcauagc

SEQ ID NO: 4204387 - RNA, 74 nt, Human herpesvirus 7
gggaauagaggugcacuuuuuauagcggaacccguauuauuugguugguacaucugaaguucacaucuguucuu

SEQ ID NO: 4204388 - RNA, 129 nt, Human herpesvirus 7
gugcauguuuucauuuauuaaguuuucgauuauaucuucuagaguuauugccgugcgugcuuuuucaagugggaccguauugguacauaucuuuaugagugaugcgaaaauuauauaaugcaguugcac

SEQ ID NO: 4204389 - RNA, 125 nt, Human herpesvirus 7
guuuuguuuauaaaguguggucugguuccacagcgugguuuucgguguuauuguucugcaucuaucggaguuuuuaguaugccaccgcuaacuacgguggcacagacaacaauauggacugagac

SEQ ID NO: 4204390 - RNA, 57 nt, Human herpesvirus 7
uagaucgcuuuaaaaucuuauuucccucuaugggacaaaaagauugugagcaauuua

SEQ ID NO: 4204391 - RNA, 86 nt, Human herpesvirus 7
ucagaaacauuuaccucacuuucuucaguacucauuccaggauuuguuucagcuggauacaugagacagucaggugagucuuuuga

SEQ ID NO: 4204392 - RNA, 112 nt, Human herpesvirus 7
ucgagcgacagucaccaagggcguagaggcagaccuaaacccagagcuaaaacauggagcgaagcuuuaucccaccgguccuuccucaacauuuacgcguggcugucuuuga

SEQ ID NO: 4204393 - RNA, 101 nt, Human herpesvirus 7
ucuguaaugaaccaaaucugauauuuuuaacacaauggcaauuagggugccgaaauaagaugccauugaaugcguuggaaauauuagcaugcaucuacaga

SEQ ID NO: 4204394 - RNA, 56 nt, Human herpesvirus 7
uguguccacuacagauauugaugacguuaucuaauauuauaucuaaaguggagaca

SEQ ID NO: 4204395 - RNA, 127 nt, Human herpesvirus 7
uugucacaguugugguuaauguuaauccagaaaaaauaaaucuauauguuguauuaaaauccauuugaaaaagauauuuuauauagauugucuccacuuuagauauaauauuagauaacgucaucaa

SEQ ID NO: 4204396 - RNA, 67 nt, Human herpesvirus 7
uuuugucaugugaaauuggcauuaaugcgauuucugaaaaggcguuuuccgguuucacauuaaaaaa

SEQ ID NO: 4204397 - RNA, 57 nt, Human herpesvirus 7
aacuuguucuguguaguauucuguguuuguuagcagggguaauaacagaacauuguu

SEQ ID NO: 4204398 - RNA, 58 nt, Human herpesvirus 7
aagggaauugauuugguuaaucauggugaaaaccguuuuaauuuucuguaauucuguu

SEQ ID NO: 4204399 - RNA, 76 nt, Human herpesvirus 7
aaguugggacaaugcuuagaaucuguagucgaugugauuuguuuuucuuuugauguacuaggucuuguucuagcuu

SEQ ID NO: 4204400 - RNA, 121 nt, Human herpesvirus 7
acugagaaucuuguuuauuguuagaacacacuuuacauguucuggauuuagaugcagaucuagaucucgauguaucagagcugcuucuagaucuguguuuuuggcgaugucuuguuuuagu

SEQ ID NO: 4204401 - RNA, 78 nt, Human herpesvirus 7
aguaaagaugccgcacauucaccuggcggugacccgaacaugucuggucaccgccauagauguccgacaaaacuuucu

SEQ ID NO: 4204402 - RNA, 72 nt, Human herpesvirus 7
augacaaauuucaggaaaaacgguguuguaauaauucauuuguuuaagacauuauuugcugaacucugucau

SEQ ID NO: 4204403 - RNA, 78 nt, Human herpesvirus 7
cagcgacagguguuguuuccgaucuaaagacacuuauuugauuauuuugauuggaaaucaaaauucugcuugucucug

SEQ ID NO: 4204404 - RNA, 64 nt, Human herpesvirus 7
cauuuucaaguguauugggauuuguguuaagaucaucagaaucuauuccacuugaaucuaagug

SEQ ID NO: 4204405 - RNA, 55 nt, Human herpesvirus 7
ccaucgaaauuuauguuuaagaaaugcuuuugaaucaacugcauaaauucggugg

SEQ ID NO: 4204406 - RNA, 78 nt, Human herpesvirus 7
cguggaaaugauaucagaacacaaucuuucgguguacaagauugaauaucgaucaccgguguuauuugucuuucuacg

SEQ ID NO: 4204407 - RNA, 112 nt, Human herpesvirus 7
cuggcacgcugugauuguauuuacgagaaaaggucuguaccauauggaauugucauggaaggaaaauuaagacaguuuauggacaauuuuggcucacugcaaagugugcuag

SEQ ID NO: 4204408 - RNA, 81 nt, Human herpesvirus 7
gaaaggauucaauacaggggcuaucagaaacuuucaacagaagaacugugauggaucugguguccuucuuuaauccguauc

SEQ ID NO: 4204409 - RNA, 59 nt, Human herpesvirus 7
gaaauacuguguucugaauuugaucuagauauagauaucaaauguuugcauuguguuuc

SEQ ID NO: 4204410 - RNA, 55 nt, Human herpesvirus 7
gaacagacacuguauuugaaagauuuccaaauuuagaugauacuuuugucaguuc

SEQ ID NO: 4204411 - RNA, 62 nt, Human herpesvirus 7
gagugcagaaaugcuccgcgcuguucagcuccagccaagacgccggggacauuccucaucuc

SEQ ID NO: 4204412 - RNA, 83 nt, Human herpesvirus 7
gaugcgacaaaggagaguuucggugaggaaaaggcuuuuuaaagagucucagcaccgcggauuuaccauucgccagucgcguc

SEQ ID NO: 4204413 - RNA, 65 nt, Human herpesvirus 7
aauacaauuucuucgauuuguauggucuuagacaaaucuugaucagcgaauugggaauaaguauu

SEQ ID NO: 4204414 - RNA, 92 nt, Human herpesvirus 7
aguuuucgauuauaucuucuagaguuauugccgugcgugcuuuuucaagugggaccguauugguacauaucuuuaugagugaugcgaaaauu

SEQ ID NO: 4204415 - RNA, 93 nt, Human herpesvirus 7
augauuaguaguacugccacuggagaaugucgaggucuuuguaaaauuuaaggauguagauucgacauucucuuuaguuguugcgauagucgu

SEQ ID NO: 4204416 - RNA, 82 nt, Human herpesvirus 7
caucucuggucaguuggagucguucuauguaugaaaaaaacauuaucgcguuuucaugcucaucgucuccaagccucagaug

SEQ ID NO: 4204417 - RNA, 87 nt, Human herpesvirus 7
caucuucagagccuacaaauaaaucuuuggauagcguguuguuacuccguuguucaguuuuuauaaaugguucuggauuaaaugaug

SEQ ID NO: 4204418 - RNA, 85 nt, Human herpesvirus 7
ccuaguaaagaugccgcacauucaccuggcggugacccgaacaugucuggucaccgccauagauguccgacaaaacuuucugugg

SEQ ID NO: 4204419 - RNA, 80 nt, Human herpesvirus 7
cuaaauggauugucuuuguauuauguugguguguugcccacuacacacugaaacauaguacaagggcuaacucuuaaugg

SEQ ID NO: 4204420 - RNA, 92 nt, Human herpesvirus 7
gagauccuuuauuucaaaauuuuagcuucacugaaaagaugcagccugugcggucuccauuuuuuuuaccaaaugcugaaauccaggauuuu

SEQ ID NO: 4204421 - RNA, 61 nt, Human herpesvirus 7
gaguauuaucaaaggaaggguugcauuuuaaacugucuugcaauaugucucugauggucuc

SEQ ID NO: 4204422 - RNA, 85 nt, Human herpesvirus 7
gaucaguuaaaucaaguauuucagucuguaguauucugugcauuuuuuuagaauuguuuauagacguggaauuucuuggcucguc

SEQ ID NO: 4204423 - RNA, 113 nt, Human herpesvirus 7
gauucuaagcauuuuuuucuuugcagauucagaagaugaaagauuucuaaaagccucaacuuccggacccagaguauuuaucauuuucgcaauaaaauaguguauaccaaauc

SEQ ID NO: 4204424 - RNA, 73 nt, Human herpesvirus 7
gcagccaccaguaacgauugagugccgcgcggagagcaaaauguucugugguugcagcagucauagguggugu

SEQ ID NO: 4204425 - RNA, 64 nt, Human herpesvirus 7
gguuucgaggggccuauuuauuaguauuuucucuaauauuucugaugaauagcuuuuuaaaucc

SEQ ID NO: 4204426 - RNA, 114 nt, Human herpesvirus 7
guguaacucugccagucucuaaacuucuagccugcaccugucaaaaauugauuaguauuuuaagauacauuuuuuacgaugacaaacagcaagacguacuggauaaaguuccac

SEQ ID NO: 4204427 - RNA, 71 nt, Human herpesvirus 7
guuuugacgguggaaaguucgacaggaaugaaauucgucuguggaaauaaauccgcuugcucuguuaaaac

SEQ ID NO: 4204428 - RNA, 64 nt, Human herpesvirus 7
uauagacauuucguuauuccaucugguaaugucauaaaacuuuuuggaaaaacagaauguggua

SEQ ID NO: 4204429 - RNA, 65 nt, Human herpesvirus 7
uccggaagagacugucauaaucugauugauacauucgcaaggaauaugaagaguucuuguuugga

SEQ ID NO: 4204430 - RNA, 59 nt, Human herpesvirus 7
ugcguuguaaaaacaauuuguaaaauccuaaggauuucagaugaucuucuugcagcgca

SEQ ID NO: 4204431 - RNA, 65 nt, Human herpesvirus 7
uugauaacaguugaaagccaaauauuugccaaaaucgguuucaauuugcguuucgcuguugccaa

SEQ ID NO: 4204432 - RNA, 93 nt, Human herpesvirus 7
uuuggaauuugggucuggaacguagagagcauuagcauuaaaauuauaaaaagugccuuuaaaaugaaguuuuuuaguuucgcccucaucgaa

SEQ ID NO: 4204433 - RNA, 60 nt, Human herpesvirus 7
gcuguacagauagaaaucguucaaaucauucuucuugaaucuauuuaaaaguucugcagc

SEQ ID NO: 4204434 - RNA, 58 nt, Human herpesvirus 7
gguggugguaagcguguaggggauuaugaguuagugagaucucuguguuuaccucacc

SEQ ID NO: 4204435 - RNA, 77 nt, Human herpesvirus 7
guaagcaauguagauauaguggacucgaaaacuguuugugagaugcacgcuguuucuaaaaauaucuauuugcuuau

SEQ ID NO: 4204436 - RNA, 67 nt, Human herpesvirus 7
gucugaaggcgcggcucuguugcguacguauccgacgggcugcaacuuuucuccgcguccgcagcac

SEQ ID NO: 4204437 - RNA, 124 nt, Human herpesvirus 7
uaggguuaggguuagggccgcagcccuagaguuaggguuaggguuagggccgcagcccuaggguuaggguuagggccgcagcccuaggguuaggguuaggguuaggguucgggccgcagcccua

SEQ ID NO: 4204438 - RNA, 67 nt, Human herpesvirus 7
ugauuuaagaggaauagcacgucgcggaucuugaagaguuuuugaugugacuauuucuugguuguua

SEQ ID NO: 4204439 - RNA, 59 nt, Human herpesvirus 7
ugucaucguaauaauggaaacugugcuaguggcaggcuuccuauguguguaugaugaua

SEQ ID NO: 4204440 - RNA, 90 nt, Human herpesvirus 7
uguuaccagcugugauuauugcauuugcuucauuuuuuggaagacuguuuagaaauggagggaauagacgauuaucaaacaaagcguuca

SEQ ID NO: 4204441 - RNA, 127 nt, Human herpesvirus 7
uuuucaguuggggcauuuauguacagagaguagacaccacuauuuuuccuguguuugcuguugacauucacaggcaucauagcuucuuuucuagucaguucaguaugugguacuguuccucugagaa

SEQ ID NO: 4204442 - RNA, 62 nt, Human herpesvirus 7
aauggcaacgguugagcaaauucuucaucaccuauagaaugaauuucuucaaaauugcuauu

SEQ ID NO: 4204443 - RNA, 91 nt, Human herpesvirus 7
agagauauagaugucauaaauuuuaguugccgugaugcaauuuuuucgcauagcgugccagaguggauuuguugacuguccucuugucucu

SEQ ID NO: 4204444 - RNA, 68 nt, Human herpesvirus 7
aggguuguaugaacaauaucguuuauuucaauauguugaagcagguuaaagauauugucagaaauccu

SEQ ID NO: 4204445 - RNA, 56 nt, Human herpesvirus 7
auggagcaaauguuuuacuacgaaauguaaaucuaauaguaagcaagugcauucau

SEQ ID NO: 4204446 - RNA, 105 nt, Human herpesvirus 7
cagcggugacuccaaacgguuugugcucuggcgucucgauagggaucguggugaaguuccaggcuccaguuaggcggccauggcaaugcuacgaguucuccucug

SEQ ID NO: 4204447 - RNA, 79 nt, Human herpesvirus 7
ccccuuauggucucuggaagcguggucugcgcagauuugacccuguguacgcuuuuuucgaguccaucguuucgggggg

SEQ ID NO: 4204448 - RNA, 75 nt, Human herpesvirus 7
cggauauauuuccagacauauuguaaaaaaauggcuaaacaugaaaucauugcaagaugcugaggauuuaauucg

SEQ ID NO: 4204449 - RNA, 85 nt, Human herpesvirus 7
cggcuauuuuaaaaguaggcugcauuguaaaauucgaugcaaguacuggaucguuagcuguaauuagucugcaauuagauggcug

SEQ ID NO: 4204450 - RNA, 84 nt, Human herpesvirus 7
cuggccaugaggaauguuucuauaauuguuauuauuuaugcacuuuguuaaauuccauuuauaguuacaaaacuuuauugccag

SEQ ID NO: 4204451 - RNA, 75 nt, Human herpesvirus 7
cuucuaucagguuguugucauuaaaagagauuccauaauaagaaucuauggaugcaccaaacacuccagaugaag

SEQ ID NO: 4204452 - RNA, 65 nt, Human herpesvirus 7
gcuguucgugcuucacaguguuggauguucuuuuuuaacauuuguggccaggcaauugaacgagu

SEQ ID NO: 4204453 - RNA, 88 nt, Human herpesvirus 7
ggacagauauaguaaacggugucaaauuuugcauauugaagcgugucaauccaaaucucagauauugcguauugucguaaauuuguuc

SEQ ID NO: 4204454 - RNA, 88 nt, Human herpesvirus 7
gucugguuccacagcgugguuuucgguguuauuguucugcaucuaucggaguuuuuaguaugccaccgcuaacuacgguggcacagac

SEQ ID NO: 4204455 - RNA, 87 nt, Human herpesvirus 7
guuguuuaaaaauaacccaucgaaauuuauguuuaagaaaugcuuuugaaucaacugcauaaauucgguggcgauuauuacgacagc

SEQ ID NO: 4204456 - RNA, 129 nt, Human herpesvirus 7
guuuagaguucaaaugucuuacaaaaaucuuuauuguuuuggaagugcagaaaguugguacaaaaauauggguuucgaccagguuaugcaauuuuuacccaaugaguacauuucggaugaaucuuuaac

SEQ ID NO: 4204457 - RNA, 106 nt, Human herpesvirus 7
guuucaauaaaaaguuugcuuuuugaaguguuuuuauuaauuuccacgcccauauccgggggguugaauauauacgcuuaaaauucaguauuuuuuaugaagagac

SEQ ID NO: 4204458 - RNA, 87 nt, Human herpesvirus 7
guuugaccuuuuugaaaaaaggauuauuuuguguguuuuuguuuggcuuauugaauggucuauuuuuuacucgaaaaucuuucaaac

SEQ ID NO: 4204459 - RNA, 56 nt, Human herpesvirus 7
uccacauaaaaagagagaugucuacgcauguagauuauaggauuuuuuuguaugga

SEQ ID NO: 4204460 - RNA, 68 nt, Human herpesvirus 7
ugacauugaaaaaaucugcuguuguacuguugugcuuacuaacggaauaguagaguuuuuggauuuca

SEQ ID NO: 4204461 - RNA, 57 nt, Human herpesvirus 7
uuuuuuauguuucuucguuuaggucuuuuagugggauauggacguaaacaggaaaga

SEQ ID NO: 4204462 - RNA, 95 nt, Human herpesvirus 8 [Kaposi`s sarcoma-associated h
auccuaucagccuugguucccagggggugucuccgucugcucacggcgcucgugcggcacgacaggcauccucugacagagguguuugagggggu

SEQ ID NO: 4204463 - RNA, 128 nt, Human herpesvirus 8 [Kaposi`s sarcoma-associated h
cacgaccgucaaggcuaggaacauguucaccgcaccaaaaauggcgucugacacgagcacguaaaagcuguugccaacggccaucauggugcucaaugaaaacagcagcauuuccaaggcgguuguug

SEQ ID NO: 4204464 - RNA, 77 nt, Human herpesvirus 8 [Kaposi`s sarcoma-associated h
cagcgucgaguacauucgcaccgaauagcucacgcgugugcgugaagccgcuaccgacggacguauuccugaagcug

SEQ ID NO: 4204465 - RNA, 63 nt, Human herpesvirus 8 [Kaposi`s sarcoma-associated h
cgguguuuuuuguacuacagcucucaggccaaugugggaaaaguaggacggaaaaccuagccg

SEQ ID NO: 4204466 - RNA, 71 nt, Human herpesvirus 8 [Kaposi`s sarcoma-associated h
cuguacagcucgauggccuugaagucuauguuuugaauaaaggauagauucagggcgauaaaaguguucag

SEQ ID NO: 4204467 - RNA, 62 nt, Human herpesvirus 8 [Kaposi`s sarcoma-associated h
gacgauguggcucgggugaaugacggaaucccacacgggcucgccgcgcccgagcugucguu

SEQ ID NO: 4204468 - RNA, 55 nt, Human herpesvirus 8 [Kaposi`s sarcoma-associated h
gcaguuagacaccguuaucucccagucaccuaggaugaacguugccucugucugc

SEQ ID NO: 4204469 - RNA, 67 nt, Human herpesvirus 8 [Kaposi`s sarcoma-associated h
gcgagcggcaucuuugacgagcgugacuauggauuauucaucucucagccccggagcgugcccucgc

SEQ ID NO: 4204470 - RNA, 71 nt, Human herpesvirus 8 [Kaposi`s sarcoma-associated h
gggcgacacgcugcccugaucauagacccaucucugauguuccauccguggcaguggcagcauguuccacc

SEQ ID NO: 4204471 - RNA, 61 nt, Human herpesvirus 8 [Kaposi`s sarcoma-associated h
guaguauagguguuguuuagccacgccuuuuaccccggcuuucaaccuaaccuagugcugc

SEQ ID NO: 4204472 - RNA, 90 nt, Human herpesvirus 8 [Kaposi`s sarcoma-associated h
uccaggaggacagcgccucagcgaggaccugcgcagaaagaugcccuccauaguuguccaggacucaucgggguucauugccugccugga

SEQ ID NO: 4204473 - RNA, 118 nt, Human herpesvirus 8 [Kaposi`s sarcoma-associated h
acaagccgguccagcucuagggaaagcaggugugccuuugucuuucguucucgauuucgcacgaguuggcugcgcaguccaagggcgacccuucuuguuucuuccauggugggcuugu

SEQ ID NO: 4204474 - RNA, 55 nt, Human herpesvirus 8 [Kaposi`s sarcoma-associated h
gacgguggacaugaucagggugcugugcaccucguuucugacgugcccuuucguc

SEQ ID NO: 4204475 - RNA, 103 nt, Human herpesvirus 8 [Kaposi`s sarcoma-associated h
gagcacuguuauaagaccaaucacgggaggcuugguggccauucgcaccaggacggagccguccaccauuccuccggugacuggagacggggaagucaugcuc

SEQ ID NO: 4204476 - RNA, 55 nt, Human herpesvirus 8 [Kaposi`s sarcoma-associated h
uccagggucaccgccucacucugggaugaaacaagauggggcgugguuacccgga

SEQ ID NO: 4204477 - RNA, 57 nt, Human herpesvirus 8 [Kaposi`s sarcoma-associated h
auccagccuuagccaucauugcgugaagcuuguggcgcuggaagaaggcugucggau

SEQ ID NO: 4204478 - RNA, 76 nt, Human herpesvirus 8 [Kaposi`s sarcoma-associated h
cccuugugcacacggcccguauggacauuucaaacccaucaucugugucucccgauggcgacgugcacuacucggg

SEQ ID NO: 4204479 - RNA, 105 nt, Human herpesvirus 8 [Kaposi`s sarcoma-associated h
gccucagcaacugcgucauguaccuggcguccagcuauuauaacagcgaaaccccccucgucgacagagccagccuggacgauguacuugaacagggcaugaggc

SEQ ID NO: 4204480 - RNA, 65 nt, Human herpesvirus 8 [Kaposi`s sarcoma-associated h
guaacagaucccggucguccacccccugacugauggauagggugccccuaaagaccgucuguugc

SEQ ID NO: 4204481 - RNA, 103 nt, Human herpesvirus 8 [Kaposi`s sarcoma-associated h
gugcccuguggaguuuucgccuaauuagcugaaucucgacccccauugcggccagcaugcucacgaggaauaggcagcagaggcaggaccuaacuaggagcau

SEQ ID NO: 4204482 - RNA, 57 nt, Human herpesvirus 8 [Kaposi`s sarcoma-associated h
uccaggucagagagcagggaugcgauuuuucguuuuuuacccacugucaggcuuggg

SEQ ID NO: 4204483 - RNA, 64 nt, Human herpesvirus 8 [Kaposi`s sarcoma-associated h
uguccaccggacgaguggcgcggcgaagacgucgccagcaccagcuucugucggugucaugaca

SEQ ID NO: 4204484 - RNA, 73 nt, Human herpesvirus 8 [Kaposi`s sarcoma-associated h
uuccguaauaucuguuuuauauagugaggguucacgcaugcgcgagucccgacuaaugaggacaauuacugaa

SEQ ID NO: 4204485 - RNA, 66 nt, Human herpesvirus 8 [Kaposi`s sarcoma-associated h
auuguaaaagauccgauccucacauagcgugggauccagaagucccgagggcggguuauuggcagu

SEQ ID NO: 4204486 - RNA, 68 nt, Human herpesvirus 8 [Kaposi`s sarcoma-associated h
ccaaucacgggaggcuugguggccauucgcaccaggacggagccguccaccauuccuccggugacugg

SEQ ID NO: 4204487 - RNA, 75 nt, Human herpesvirus 8 [Kaposi`s sarcoma-associated h
gagaucucaggccuuuguagaggccaucucgccggaacgccuagcgggucuccugcggaggccaauagacgucuc

SEQ ID NO: 4204488 - RNA, 62 nt, Human herpesvirus 8 [Kaposi`s sarcoma-associated h
gaggaauccggggaugugaugaaguugggcauauugucuaaaucccagcaugccagauuuuc

SEQ ID NO: 4204489 - RNA, 82 nt, Human herpesvirus 8 [Kaposi`s sarcoma-associated h
gaucaccacuuuaauauccucuggaucgcagcagugggaccaccacaucagcuuguccugugggggauacacuguggugguu

SEQ ID NO: 4204490 - RNA, 55 nt, Human herpesvirus 8 [Kaposi`s sarcoma-associated h
ggacaucgccguggaccccggacugcuaacccgccggauuccauccguggugccc

SEQ ID NO: 4204491 - RNA, 115 nt, Human herpesvirus 8 [Kaposi`s sarcoma-associated h
uccaggccugggccuacuguaggcgcgagguugucguguuugugaccuuacugcuggccacccugauaucgacggccucgaucggccugcugacuccgguccugauuggccugga

SEQ ID NO: 4204492 - RNA, 130 nt, Human herpesvirus 8 [Kaposi`s sarcoma-associated h
uguacgcccuucuguaccaccaccugcaacugagcaaccacaaugacucccaggucuagauuggccacccuggggacugucauccuguuggucugcuuuugcgcaggcgcggcgcacucgaggggugaca

SEQ ID NO: 4204493 - RNA, 70 nt, Human metapneumovirus
uguuuuuauuaagcuggguccaucggcacauguaagguucucuacaucgccuaccuccaguguaaaaaca

SEQ ID NO: 4204494 - RNA, 58 nt, Human metapneumovirus
gcaaggcauaugaagagucauuuucagcaccugcugauaagucaauuaugagcuuugc

SEQ ID NO: 4204495 - RNA, 102 nt, Human parainfluenza virus 1 strain Washington/1964
gugauugucucuuugauuauuuuggcacuuucguucauggaggauacugucaugauguuugucuucauacaagugucuuguuuuauaauuaggucaaugcau

SEQ ID NO: 4204496 - RNA, 64 nt, Human parainfluenza virus 1 strain Washington/1964
agagcuaaugggugucauuauugaggaguguagacuuauauccuccugauuuucccgaugcuuu

SEQ ID NO: 4204497 - RNA, 82 nt, Human parainfluenza virus 1 strain Washington/1964
gguuaucagguauuaauuguguaggaucucuaggacauauauaugccaauuuugauucuauacaguuugugacaucugcacc

SEQ ID NO: 4204498 - RNA, 85 nt, Human parainfluenza virus 1 strain Washington/1964
uguaguacacacaauugauaugaauuauuggucugaugaugaaauaauuagagcaacuaguauauguacagcuaugacuauugca

SEQ ID NO: 4204499 - RNA, 90 nt, Human parainfluenza virus 2
cugcgguugcaauuguucuugaugcaucuaucacaucggauacugccuuguugguggauugaauugaagaugcaagauuguuuaucgcag

SEQ ID NO: 4204500 - RNA, 101 nt, Human parainfluenza virus 2
gcaguugauucgagaucuauauggacaagggaugcuuucucugcuccuacuuuauguauuaugaaugcaacugcauccuuuguugauaagucuguaacugc

SEQ ID NO: 4204501 - RNA, 78 nt, Human parainfluenza virus 3
gcccaagcauauugaauuauagaugauugagguucuccaucucguucuugaucugaucuauguucgaauuguucuggc

SEQ ID NO: 4204502 - RNA, 62 nt, Human parainfluenza virus 3
gcuacucccagagcaaugguuccaauuaccccuccaaagaaucguuuuguucugggauuagu

SEQ ID NO: 4204503 - RNA, 69 nt, Human parechovirus 2
uguccaaauuucuucuuucccuuaccagcaccaaaaccagcaacacguaaauauagaggagauuuggca

SEQ ID NO: 4204504 - RNA, 68 nt, Human parechovirus 2
cccagggcuaauuagauuuguaguguagaugcacaucaucagauuacaaagugaauucagaacugugg

SEQ ID NO: 4204505 - RNA, 104 nt, Human parechovirus 2
ucuacugcuuucagacauauugauugguggauacaaacuuuguugaaaauuaaggauaugguacuaucaguauuuaagcccaguguggagaagagagcaguuga

SEQ ID NO: 4204506 - RNA, 101 nt, Human parechovirus 2
uuuggagcugaagugaccgguucacgcaaggacgaaccaccaucauugaaaccaaggauggagguugaauuccuuaagcgcaagccagguuacuuuccaga

SEQ ID NO: 4204507 - RNA, 79 nt, Human parechovirus 2
caaugcuuuagguuauuuacuguguaaaccauugcuaacugguaccagcucugguagaauagagauauuccuuagcuug

SEQ ID NO: 4204508 - RNA, 69 nt, Human respiratory syncytial virus
gucuguuuuauugauguuguugauugcugagugaguugaucacugaucaaaaaucaucaagugacagau

SEQ ID NO: 4204509 - RNA, 60 nt, Human respiratory syncytial virus
agucuaaccuuuucaaucagaaauggggugcaauucacugagcaugauaaagguuagauu

SEQ ID NO: 4204510 - RNA, 63 nt, Human respiratory syncytial virus
auuuuuguuggaugcagugcauuuaguuuuaccauagcaugacacuauagcuccaagagaagu

SEQ ID NO: 4204511 - RNA, 69 nt, Human respiratory syncytial virus
gcuaucuuucuucuuaggaucuuuggaugaugcgaacuugcccuuuauugauucuaggaauuugguagc

SEQ ID NO: 4204512 - RNA, 80 nt, Human respiratory syncytial virus
ggcugacuucacuugguaaugucaaacuguucauagugucacaaaauacucgauuggacuguacuuuacaagugucagcc

SEQ ID NO: 4204513 - RNA, 81 nt, Human respiratory syncytial virus
ucagccuuagcagauuaaauguuugcuuaauuacuuggauaaguaauuguuugaauacauuaaauaaaagcuuagggcuga

SEQ ID NO: 4204514 - RNA, 62 nt, Human respiratory syncytial virus
acccucaucuuauagauguuuuugugcacuuuggcauugcacaaucaucaacaagagggggu

SEQ ID NO: 4204515 - RNA, 63 nt, Human rhinovirus 89
cagaugcauuuguuccugauugccauguguaaucaucacguuuuucggggacaggugcuccug

SEQ ID NO: 4204516 - RNA, 73 nt, Human rhinovirus B
uacucuggccauucagcauaacacacaacagcguuggcugcuucuuguguuguuauuguugaauucccgagug

SEQ ID NO: 4204517 - RNA, 65 nt, Human T-lymphotropic virus 1
ggguuuuuuaggcuggacaacuaacacuuugguuuugucuuuggggguccaggccugacaagccc

SEQ ID NO: 4204518 - RNA, 123 nt, Human T-lymphotropic virus 2
agugagaucggggggcccuggggaaggagaggugagggugguaguaauggcauugguggcucuuaggucaugaaugaaccuccauuuaccauuugguuuuuuaacggggaagacgggguuauu

SEQ ID NO: 4204519 - RNA, 57 nt, Human T-lymphotropic virus 2
caagcucuugggucccgguacccgugaagggcagaauauagggauuguagguguuug

SEQ ID NO: 4204520 - RNA, 59 nt, Human T-lymphotropic virus 2
ccacggcaguuauguuguagagcuuguugaauggcauguaacgcauggaguuguugugg

SEQ ID NO: 4204521 - RNA, 78 nt, Human T-lymphotropic virus 2
cugguuaugucgguuuuguaaccgcuguggaagggccuggauuuggcggaggauacaggggccaaacaauaugacgag

SEQ ID NO: 4204522 - RNA, 91 nt, Human T-lymphotropic virus 2
ggaaacauuuuccucaugggguugaggacggcugcuaauuguuguucgaagaggguggggcuguuuuuaaaccccuguggaaggacagucc

SEQ ID NO: 4204523 - RNA, 80 nt, Human T-lymphotropic virus 2
gagaggcuggaucuauccacgcaaaccaugcaggaguaauuggugcucuguaaggucagcuggauaaauuugaguauuuu

SEQ ID NO: 4204524 - RNA, 56 nt, Influenza A virus
uccuggaagagaaggcaauggugaaauuucgccaacaauugcucccucuucgguga

SEQ ID NO: 4204525 - RNA, 92 nt, Influenza A virus
ggugccuuacugaaugacaggcauucaaaugggacuguuaaggacagaagcccuuauagggccuuaaugagcugcccugucggugaagcucc

SEQ ID NO: 4204526 - RNA, 120 nt, Influenza B virus
cuggugccgucucuguauugauaacauuacugguugauaaccugauguuuucauauccucugagaagauuagguaguugucugauuuuuguucugucgugcauuauaggaaagcauccag

SEQ ID NO: 4204527 - RNA, 82 nt, Japanese encephalitis virus
gaucuucugcucuaucucaacaucagcuacuaggcacagagcgccgaaguauguagcugguggugaggaagaacacaggauc

SEQ ID NO: 4204528 - RNA, 99 nt, Japanese encephalitis virus
aauggugaaaugguugacccuuuucagcugggccuucuggugauguuucuggccacccaggagguccuucgcaagagguggacggccagauugaccauu

SEQ ID NO: 4204529 - RNA, 64 nt, Japanese encephalitis virus
accaguccauugggcauguguauguugucuaacaugaucuuugccucuguccaaugggcuaggu

SEQ ID NO: 4204530 - RNA, 84 nt, Japanese encephalitis virus
agauccuguguucuuccucaccaccagcuacauacuucggcgcucugugccuaguagcugauguugagauagagcagaagaucu

SEQ ID NO: 4204531 - RNA, 69 nt, Japanese encephalitis virus
gaccuugaccacuuugugccuguaagucaguucaauuauggcucgagcgagcaugcgguguucaccguc

SEQ ID NO: 4204532 - RNA, 71 nt, Japanese encephalitis virus
guggugaagcucaugagcaaaccuugggacgccauugccaacgucaccaccauggccaugacugacaccac

SEQ ID NO: 4204533 - RNA, 57 nt, Marburg virus
cuccggacccugaaccggauguuaugagguccucaucaucauuguuugggucugugg

SEQ ID NO: 4204534 - RNA, 128 nt, Marburg virus
ggcugugggcaguggugaggguauuuuggacggagcacauguuugauucuucguggaguuguauucuugaagagcaccgaagcauccagugucauucguuuguguuccauuguuacuuguccaauauu

SEQ ID NO: 4204535 - RNA, 58 nt, Measles virus
acccuucaccugaagcuugagcauuccggauugugucugcagcaugcagggggagggu

SEQ ID NO: 4204536 - RNA, 77 nt, Measles virus
cgguuacucuggaggagcagaugcaagauaguaagaauccaggcaguuuugcagccaucaguuccucaagaauuccg

SEQ ID NO: 4204537 - RNA, 82 nt, Measles virus
gcuucggaaaguuguugccucuggauuggaguuucaggagcucguggaucuccccuccuucugcaguuucaacaucagaagc

SEQ ID NO: 4204538 - RNA, 59 nt, Measles virus
gccugguuuuugcacuuggugggauagggggcaccagucuucacauuagaagcacaggc

SEQ ID NO: 4204539 - RNA, 66 nt, Measles virus
ugaguauagaguuaagcaauccaucuugcccugaggcaacaucaugguggauuaauucuuugcaca

SEQ ID NO: 4204540 - RNA, 64 nt, Measles virus
uuguuucgacucgagaaagauacuggaucaucuaacacgguauuacaucuucacgucgaaacag

SEQ ID NO: 4204541 - RNA, 120 nt, Measles virus
cccaugccgacuugucgaaaucguagaucucugucauuguggaacuuaggaggcaaucacuuugcuccuaaguuuuuuauaauggauuuagguuguacuaauuaggucgacuggcauggg

SEQ ID NO: 4204542 - RNA, 70 nt, Measles virus
ccguaagcuggggccaaauaaugacaggauuucuguauaguaucugagcaauuugagcccuagcuucugg

SEQ ID NO: 4204543 - RNA, 90 nt, Measles virus
ggaucuuccuuguugacucuuugucuucuauguuaaauaaauccugauuacaauuuggauauggaauaugagagugggccggauaacucc

SEQ ID NO: 4204544 - RNA, 92 nt, Measles virus
aauugguuccaaaacuguucucaguagucuccuguauucugcgaucucuacccucgugcaguuauugaggagaguuauauugggcauuaauu

SEQ ID NO: 4204545 - RNA, 70 nt, Measles virus
ccagaagcuagggcucaaauugcucagauacuauacagaaauccugucauuauuuggccccagcuuacgg

SEQ ID NO: 4204546 - RNA, 94 nt, Measles virus
ccaguccguuuuugacauggcgugccugcucuucugccaucggcuccagucgugggaguggaugguugguuggcuggcggcuguguggaccugg

SEQ ID NO: 4204547 - RNA, 80 nt, Molluscum contagiosum virus
aaguuguacagcguggcaugcugcacgucguccagccgcugcuccacgaagcacagcaugcaguagccgcuguacugcuu

SEQ ID NO: 4204548 - RNA, 58 nt, Molluscum contagiosum virus
agcgcuacgugcuggaacaggugcacgcgcgugcgcgcccugcgccgcacguauggcu

SEQ ID NO: 4204549 - RNA, 58 nt, Molluscum contagiosum virus
aggaagcgcucuagguuggguguguacgcgucgcggcacacuaacagcgcgcuguccu

SEQ ID NO: 4204550 - RNA, 65 nt, Molluscum contagiosum virus
cagaacagcacguuguucuugcgcguggcgaugucgccgcagugcucgcacacgugcacguccug

SEQ ID NO: 4204551 - RNA, 78 nt, Molluscum contagiosum virus
cagccgccugccgcgcucgugccgccugcgcgcacccgagggcgugcgcuuugaggaacuagugcugcugggcgguug

SEQ ID NO: 4204552 - RNA, 64 nt, Molluscum contagiosum virus
cagcucgcgcagcgcaucggggggaaacuccaaggccagcuccucgguguacugcuugcaguug

SEQ ID NO: 4204553 - RNA, 72 nt, Molluscum contagiosum virus
ccgugagugucgcgaccguagaagaugcuggcauguaccuugucacugucgcgacaacaacaagcuacacgg

SEQ ID NO: 4204554 - RNA, 60 nt, Molluscum contagiosum virus
ccuucuucuugaagccgcgcagcuuguucagagagaagaucgcgaucuugaaggaguagg

SEQ ID NO: 4204555 - RNA, 79 nt, Molluscum contagiosum virus
cgagagaaagcugaugcccucguugccgcugagcgagaagacgcagguuuugaugagcucgccguugguguucucuacg

SEQ ID NO: 4204556 - RNA, 71 nt, Molluscum contagiosum virus
cgcauguagcucuggaugugcucggugaguagcgcacgcgcuuggcgcucgucuuccagagccugcgagcg

SEQ ID NO: 4204557 - RNA, 56 nt, Molluscum contagiosum virus
cgcgccgaggacuaccuggcggcgcuggagacggcaguguccugguucuuugcgcg

SEQ ID NO: 4204558 - RNA, 78 nt, Molluscum contagiosum virus
cgcgcgcagucccucgcgcgucuccgcguagaaugggucugacggguccaacgcggaggcgcgcgcggccagcgcgcg

SEQ ID NO: 4204559 - RNA, 89 nt, Molluscum contagiosum virus
cgcgcgcgcgcacgcgcuuggagcgcgggcgcagaggcaggggcguucccuugcgcuugugcguacgcgcgggcgcggacgcgggcgcg

SEQ ID NO: 4204560 - RNA, 57 nt, Molluscum contagiosum virus
cgcgggcgcagacgccgagcgggcaaugggcacgcucuacggcgugcugugccugcg

SEQ ID NO: 4204561 - RNA, 55 nt, Molluscum contagiosum virus
cgcuuggcgggcagcggcgacgacgacuucggcgcaacgcuggccgccauccgcg

SEQ ID NO: 4204562 - RNA, 91 nt, Molluscum contagiosum virus
cgucgcggcguaucaucuccacaauggcggcgcgcgacuucgcggcgcucgcggcgcucgcggcgccgcuguccugugagugcgcucggcg

SEQ ID NO: 4204563 - RNA, 62 nt, Molluscum contagiosum virus
cgugcgccgcgcccagucgaccagcgcguuguagcgugucguguccgcgggcucggcgcgcg

SEQ ID NO: 4204564 - RNA, 64 nt, Molluscum contagiosum virus
cgugcucacggcagcguaauccuugccagagaaggauucuuuuuucacguugcuaauggcggcg

SEQ ID NO: 4204565 - RNA, 82 nt, Molluscum contagiosum virus
cugcgagucgcccguguucgcggagcugugccgcagcaacccgcggcucucgcggcccuucguguucgcggacggcgcgcag

SEQ ID NO: 4204566 - RNA, 79 nt, Molluscum contagiosum virus
cuggccucgcccagauccgcccagcuugcaacugcaaugucugugugcgaucuggagaacuugccuuuugcggggucag

SEQ ID NO: 4204567 - RNA, 59 nt, Molluscum contagiosum virus
cugggagcaccgcguggcgcgcgacgugugcucugugcgcgcagacguggugcucgugg

SEQ ID NO: 4204568 - RNA, 122 nt, Molluscum contagiosum virus
cugucgaugauguggcggcccucuucguccugcaugacgauguagcucuugagguaggguaccuugagcaggagcacguuccugccggugaugaaguagaugaggaaagccagguugaucag

SEQ ID NO: 4204569 - RNA, 68 nt, Molluscum contagiosum virus
cuuuugcgggggcgcgcgaaugcgcucgccgccuagaagccggcgcguucccgcagcgccugcggaag

SEQ ID NO: 4204570 - RNA, 55 nt, Molluscum contagiosum virus
gacagucuagugcguccgcccuuacgacaagcguaagccaccgcgcaggaccguc

SEQ ID NO: 4204571 - RNA, 57 nt, Molluscum contagiosum virus
gauggagguccagggcacggucggagaagucucgcacgaccuucuggggcucgaguc

SEQ ID NO: 4204572 - RNA, 59 nt, Molluscum contagiosum virus
gcacagcucgcgcugcgucugcgagaugagcgugucaaagcagucguacgugagcaugc

SEQ ID NO: 4204573 - RNA, 66 nt, Molluscum contagiosum virus
gcacauguacggcguacacaacuuccgcgugggcauguucaaccucacguacacgccgcacauugc

SEQ ID NO: 4204574 - RNA, 87 nt, Molluscum contagiosum virus
gcacguccgcgggcgcguaggccagcaccugagccagcaggucaaagugcucgccggccagcagcgugcgcgccagcgcgggcaugu

SEQ ID NO: 4204575 - RNA, 55 nt, Molluscum contagiosum virus
gccauggccagcuucugcgccgcgcagcccggaagcgcgccgugccuggccuggc

SEQ ID NO: 4204576 - RNA, 56 nt, Molluscum contagiosum virus
gccccugcacguucacgcgcuccaggagccccacgggcgcggagaacugcaccagc

SEQ ID NO: 4204577 - RNA, 57 nt, Molluscum contagiosum virus
gcccuuugccacggcgagucacgucucugaaggcuuggcuucucgacuggagggggc

SEQ ID NO: 4204578 - RNA, 60 nt, Molluscum contagiosum virus
gccgccaggcggcgcgugcucuccaccagcgcguugaccagguacacggccucuggcggc

SEQ ID NO: 4204579 - RNA, 125 nt, Molluscum contagiosum virus
gccuggcgcgcgcgcgcgccgcgcguagugcucuuuguggaccgcggcgucaucgacaucaagcgcgcucugcgccagcgccgccaggacagcauugccgcggcgugcgcgcguaagcgcgaggc

SEQ ID NO: 4204580 - RNA, 81 nt, Molluscum contagiosum virus
gcgagaacuacgccaggugcacgaccgcgcgcugcugcgccuggacgcagagcccgugcaugugagccauggcuaccuugc

SEQ ID NO: 4204581 - RNA, 78 nt, Molluscum contagiosum virus
gcgagcaccucacggagcgcgagaagaaguacauccugcagauuaucacgcacggacgcucgugaggaaagcguucgc

SEQ ID NO: 4204582 - RNA, 55 nt, Molluscum contagiosum virus
gcgaggcgcuggucucguucgacgcucgccgcugcgucaacaggcuggucuucgc

SEQ ID NO: 4204583 - RNA, 58 nt, Molluscum contagiosum virus
gcgccggcuggcaauguagcguaccagcgacugcagguugcgcacgccgugcuggcgc

SEQ ID NO: 4204584 - RNA, 78 nt, Molluscum contagiosum virus
gcgcgcagcgcccgcguacacgugcacgcgcacggguguggcccccgaguacgugagcacaguguagcgcgcgcgcgc

SEQ ID NO: 4204585 - RNA, 64 nt, Molluscum contagiosum virus
gcgcgcgccgagcccgcggacacgacacgcuacaacgcgcuggucgacugggcgcggcgcacgu

SEQ ID NO: 4204586 - RNA, 63 nt, Molluscum contagiosum virus
gcggcucuccgcacacgugcucguugccgcaguggcgcgcaagacgaguagugcgcgagccgc

SEQ ID NO: 4204587 - RNA, 56 nt, Molluscum contagiosum virus
gcgugcuggccagcgcgcguccgcgcucgcgcucgaugcgcgccuuggcuagcagc

SEQ ID NO: 4204588 - RNA, 78 nt, Molluscum contagiosum virus
gcucgcugaagcugugcgcgcaggccacgggguuggcgugcucgcugacgccggcgcgcgugggcagcaucucgacgc

SEQ ID NO: 4204589 - RNA, 83 nt, Molluscum contagiosum virus
gcucguagcccaugugcucgcgugccuugcgcgugcguaugacgaagcaggcauuggcaacggcgagcguguaaggguugagc

SEQ ID NO: 4204590 - RNA, 63 nt, Molluscum contagiosum virus
gcucuggguccgguuccgaauaccagucggcgcugagcgccuucggagggucggagccugagc

SEQ ID NO: 4204591 - RNA, 97 nt, Molluscum contagiosum virus
ggagagacgcucagaacguggucaagauccaagcgcaacacggccuucuccucgcucugcucuugaugcugaacgaucucugacccgcgccuacucc

SEQ ID NO: 4204592 - RNA, 92 nt, Molluscum contagiosum virus
ggcagcgcuuguuucgcaugcacagccgcuuucugggcgcgugcgagcggcgcgcgcugagcgcggagcuggcguugccgagcgagcacgcc

SEQ ID NO: 4204593 - RNA, 72 nt, Molluscum contagiosum virus
ggcaggaagggcgcugaacuuagcgcgcagccggcgcgaaccggcacgccucaagcucgggcccagaccgcc

SEQ ID NO: 4204594 - RNA, 72 nt, Molluscum contagiosum virus
ggcgcagcaggaugcuggugucgagcucgcgcgccagcacgcgcucguccgccgcgucguagcaaaugcgcu

SEQ ID NO: 4204595 - RNA, 64 nt, Molluscum contagiosum virus
ggcgcugggcgcgccgcgcgcgccgggaaugcugcgcacgcuagucguuggcgcgcccggcgcc

SEQ ID NO: 4204596 - RNA, 86 nt, Molluscum contagiosum virus
gggaaguguugccgccggccuuguucgcgcuucugccccguccucgcucgugcucuuggcguucgcagugcccgggggcgcuuccc

SEQ ID NO: 4204597 - RNA, 85 nt, Molluscum contagiosum virus
gggcgcgagcgugaacgcgcgcgugcgguguugcucgaagggcuccacgagcaauucgcuuugcagcccgcacucacgcacgccc

SEQ ID NO: 4204598 - RNA, 56 nt, Molluscum contagiosum virus
gggcgcugaacuuagcgcgcagccggcgcgaaccggcacgccucaagcucgggccc

SEQ ID NO: 4204599 - RNA, 91 nt, Molluscum contagiosum virus
gguaacgucggcgggcucggaaggugucgcgucugcguguuuugcgcugacggugcucccgacgccuucugagcccgagcugacagugacc

SEQ ID NO: 4204600 - RNA, 91 nt, Molluscum contagiosum virus
ggucacugucagcucgggcucagaaggcgucgggagcaccgucagcgcaaaacacgcagacgcgacaccuuccgagcccgccgacguuacc

SEQ ID NO: 4204601 - RNA, 80 nt, Molluscum contagiosum virus
ggucucuguucuccgcggcgcgucgagcuugggcgugugccacgcucgcuccuuauucucggcuugccgcacacacgacc

SEQ ID NO: 4204602 - RNA, 75 nt, Molluscum contagiosum virus
guacggugcgagccugcgcgcgcgcgccggcgccuggcuggcucgcaacuacccgcaggccuacgccgccgcuac

SEQ ID NO: 4204603 - RNA, 66 nt, Molluscum contagiosum virus
gucgcccaucacgucgaagaucaagcuggacaucgagaccagcuuuaucuucguggagacggcgac

SEQ ID NO: 4204604 - RNA, 69 nt, Molluscum contagiosum virus
gugccgcgugcgcgggcaguuccgcgcguucgaacacguguucgaacugcucgcguugguuugcagcac

SEQ ID NO: 4204605 - RNA, 121 nt, Molluscum contagiosum virus
gugugcgcucacacggaacgagaacaagugugugugugugugugcucacacggaacgagaacaaguuugugugugcgcucacacggaacgagaacaagugugugugugugugugcucacac

SEQ ID NO: 4204606 - RNA, 58 nt, Molluscum contagiosum virus
gugugugugcgugcucacacggaacgagaacaaguuugugugugcgcucacacggaac

SEQ ID NO: 4204607 - RNA, 66 nt, Molluscum contagiosum virus
ucacgcgcagcucaaugagcgugcgcucacauugcagcagugcgcguacaauguagcugccgauga

SEQ ID NO: 4204608 - RNA, 63 nt, Molluscum contagiosum virus
ucaugggcucgggcaagaccaucaucgcgcugcucuucgcgcugaucguguccaaguucaaga

SEQ ID NO: 4204609 - RNA, 74 nt, Molluscum contagiosum virus
ucgagcacguccaugggcucguccuguacuggcguucccacgcccacagucaugugcccaugugcuacugccga

SEQ ID NO: 4204610 - RNA, 76 nt, Molluscum contagiosum virus
ucgcgggacgggcucccuaagcgagcgaguugcgucuuucgcacgcagcucugcgcuaucgagcacgucgugguga

SEQ ID NO: 4204611 - RNA, 100 nt, Molluscum contagiosum virus
ucguccggauucaugucugucggcaacgucggugcacguugcucgaccgcuuuccgcagcuguucgcgcagagauguugucaagccgucggauccgacga

SEQ ID NO: 4204612 - RNA, 83 nt, Molluscum contagiosum virus
ucuaccgccggaggcacgcuggcacuugcgggugccucgaauccugucacugcugccgcggggcuagcgcugcagggcguagg

SEQ ID NO: 4204613 - RNA, 64 nt, Molluscum contagiosum virus
ugaccuugggcuccucgcgcagcgccacgugcgugcguacagugcucgcaaaggagucgcggca

SEQ ID NO: 4204614 - RNA, 68 nt, Molluscum contagiosum virus
acaccccuagaggugcacgcagagcuggucgcccugcgcagggcggccgcgagcagcugugggggugu

SEQ ID NO: 4204615 - RNA, 81 nt, Molluscum contagiosum virus
acgugcgaagucauggccccuugucuaguuggagauauauuuucauuuugaacucuugcgagcggcaaccagcaaguacgu

SEQ ID NO: 4204616 - RNA, 61 nt, Molluscum contagiosum virus
acugcgcagccgccgaguauggcguguuuauaccccgcgugugcucgcucgugcugccggu

SEQ ID NO: 4204617 - RNA, 55 nt, Molluscum contagiosum virus
agcccgcaguauugcgcgagccccagcauccugcguccgcacgcgcgcucgggcu

SEQ ID NO: 4204618 - RNA, 55 nt, Molluscum contagiosum virus
aucagcgcgaucucgaucgaacacgcagacgggcgucucgauaaucgcgacuggu

SEQ ID NO: 4204619 - RNA, 71 nt, Molluscum contagiosum virus
augcgcacgaucagguagagcgcgcagccggccacuugcggcaggaauugcagcgccugcgacgagcgcau

SEQ ID NO: 4204620 - RNA, 100 nt, Molluscum contagiosum virus
auggagcgucuucuuguugugcuuugaugacuaugcgucuuccugcugccgggagaggaaaggcgcacccucacaccuagagcacgaagcuacgcuccgu

SEQ ID NO: 4204621 - RNA, 72 nt, Molluscum contagiosum virus
cacaucaugggcucgggcaagaccaucaucgcgcugcucuucgcgcugaucguguccaaguucaagaaggug

SEQ ID NO: 4204622 - RNA, 124 nt, Molluscum contagiosum virus
cagcagguugaagaugcccagcuccuugaggcucaugagcuccacggucaugcggaacaugcgccgcgugcuguggaagucgucauaggccugguacucggaaauggggaucuuguacuugcug

SEQ ID NO: 4204623 - RNA, 126 nt, Molluscum contagiosum virus
ccgcguagacuugcaucgagcugcgguugagcgcgagcccggaugcgugcacgucgagcacggccagcaagaggucgugcgccgcggcgcgcgccaacucgcgcaccacgccagccguccacgugg

SEQ ID NO: 4204624 - RNA, 112 nt, Molluscum contagiosum virus
ccuaggagcucgggggcugguagugcuuggguucccguguaaccaguucggucaccaggaaaacgcccagaaugccgagaucuugccuucccugaagcacguccguccuggg

SEQ ID NO: 4204625 - RNA, 55 nt, Molluscum contagiosum virus
ccugcggggugccuuuccugcgggguaccuuuccugcggguaccuuuccugcggg

SEQ ID NO: 4204626 - RNA, 63 nt, Molluscum contagiosum virus
ccuucgugcacgccuucgacgccaucuucuacccgcccgcgggcgacguggcgcgcgccgagg

SEQ ID NO: 4204627 - RNA, 125 nt, Molluscum contagiosum virus
cgacacaggugcgugugcuuguugcuaggcguguccgcagcugugcgcgugcuugccgccgcacagcugcgggcugcggcuacgugccacaguuccuuccguuuuuuguauacgcaucgaagucg

SEQ ID NO: 4204628 - RNA, 89 nt, Molluscum contagiosum virus
cgccgcggcgcgcagguuuucgggccuuaaaugaacaccaaggaguccgugcugcuggagaucaucccgaagauccgcgcguaccugcg

SEQ ID NO: 4204629 - RNA, 78 nt, Molluscum contagiosum virus
cgcgugauggcgauggaaacagaaacccugguccugucgaacucgcgggugcagggcccuguuuuguacgcucacgug

SEQ ID NO: 4204630 - RNA, 66 nt, Molluscum contagiosum virus
cgcgugggcggcagagagccggcgcucgcaccagaggcgcgcgccgcgccuguguccgucuccgcg

SEQ ID NO: 4204631 - RNA, 74 nt, Molluscum contagiosum virus
cgcucggugaugcgcgacauggacaucgccagugcguagucgcgcgcgggcagcaugucgcgcagcaccaggcg

SEQ ID NO: 4204632 - RNA, 58 nt, Molluscum contagiosum virus
cggcgccucgagcgcgcuggacuugcgcgagcgagugaaggucgcguuccaggugcug

SEQ ID NO: 4204633 - RNA, 78 nt, Molluscum contagiosum virus
cggcgcggugcgucgcugcgcguggugggcacgcgcaagacgcccgacagcccgcacgugcacgcgcgcacgccgccg

SEQ ID NO: 4204634 - RNA, 84 nt, Molluscum contagiosum virus
cgucguucgacaaggacguccuguagcaaggggucugccguucggcgaggaugccuuucaggggucugucguuuuacaaugacg

SEQ ID NO: 4204635 - RNA, 75 nt, Molluscum contagiosum virus
cuaccuugucaaagaccgggcgguaguuggugucgaugaugaugguggcaugguugcgguuguugaugcgguugg

SEQ ID NO: 4204636 - RNA, 70 nt, Molluscum contagiosum virus
cucugugcggcgccguggcgcgcgacgacguugugcuccuuguccgagcgaaccgcggcagccuugcgag

SEQ ID NO: 4204637 - RNA, 90 nt, Molluscum contagiosum virus
cugccgcugccugugcccaguuauucucugcgcgcaagucaccgcuccgcagccggagcuugcgcgcggugcgggcgcgagcgacggcag

SEQ ID NO: 4204638 - RNA, 55 nt, Molluscum contagiosum virus
cugcgcguacgccgcaugguugagaaugugcuuggucauguggaugucgcaguag

SEQ ID NO: 4204639 - RNA, 67 nt, Molluscum contagiosum virus
gaaacgcucggccucggagcgcggcacgcgcucgaacgcgcccgcguccagcuccagguuuagcuuc

SEQ ID NO: 4204640 - RNA, 130 nt, Molluscum contagiosum virus
gacgcccuccucgaccugcacgacccucuucgacuuacggacgcccuccucgaccugcacgacccucuucucgagugcacguaaagacggcgauucgugcucguguugugccugcgucuagccgcgcguc

SEQ ID NO: 4204641 - RNA, 84 nt, Molluscum contagiosum virus
gacggccuccgaguccuccgcggccaauucgcgcucgcagaugcgcagcggcgacucuggcacguggucgggcauggggcaguu

SEQ ID NO: 4204642 - RNA, 86 nt, Molluscum contagiosum virus
gacguggagaugcucauggacgcgcucgggcuuccgcgcacucuagcggucucgcgaguugcguucgugcgcgcacucaccgcguu

SEQ ID NO: 4204643 - RNA, 84 nt, Molluscum contagiosum virus
gagcucgcuccgcggcagcagcgcgugccgcagaagguuguagccguugaccuuguacugcacgugcuccgcgucgaugagcuc

SEQ ID NO: 4204644 - RNA, 85 nt, Molluscum contagiosum virus
gaggcgcccccgcggaagccgcgcccgcgagcuugacaacuccgaucucaucgcacgcuggugucgcuuccaugggcuccgcguc

SEQ ID NO: 4204645 - RNA, 66 nt, Molluscum contagiosum virus
gcacacgacggcggguucucgucccgugugcgcggguacacgacggcggguucucgucccgugugc

SEQ ID NO: 4204646 - RNA, 67 nt, Molluscum contagiosum virus
gcagaacagcacguuguucuugcgcguggcgaugucgccgcagugcucgcacacgugcacguccugc

SEQ ID NO: 4204647 - RNA, 73 nt, Molluscum contagiosum virus
gcagcaguagaaaaugcccagccgaauguucaggaugagcuugcggaucauggugugcacguucgcgcgcugc

SEQ ID NO: 4204648 - RNA, 65 nt, Molluscum contagiosum virus
gcaggcagcgcaagcgcaggcaguacgcggccacguacgcgcgcagcagugccagcgcuguccgc

SEQ ID NO: 4204649 - RNA, 67 nt, Molluscum contagiosum virus
gcaugucagccacggcuguuccguggcguuguaguacgcuucguccaccagcgugugguugaucagc

SEQ ID NO: 4204650 - RNA, 60 nt, Molluscum contagiosum virus
gccaggcgccgcgcccgcgcgcaccaccgacaccagcgcgggccggaagcccacgauggc

SEQ ID NO: 4204651 - RNA, 70 nt, Molluscum contagiosum virus
gccauuuaaaaagcggaaaaaugcacgcccgggcauggcucugcgucuggcuuuucguuuuuugcguggc

SEQ ID NO: 4204652 - RNA, 127 nt, Molluscum contagiosum virus
gcccucguuggccugccggaucagcuuggucuucuugccgcggcagcgcaccguggccuuguccugcgugaggugccgcagccgcagguaguagauggggcccaugaagacggcggccgcguagggc

SEQ ID NO: 4204653 - RNA, 63 nt, Molluscum contagiosum virus
gcccugugcccgaguagaagagcguggacacgaagacgaagcgcucgcucgcgcgcagcucgc

SEQ ID NO: 4204654 - RNA, 116 nt, Molluscum contagiosum virus
gccgccggggcgcgccgacgccgccggggcgcgccgacgucaccgggcgcgccaacgccgccgggcgcgccgacgucaccgggcgcgccaacgcugccgggcgcgccaaagguugu

SEQ ID NO: 4204655 - RNA, 76 nt, Molluscum contagiosum virus
gccgcgacaucuuccgcuuccuggugggccaggacauuuacuaccccggcauccuggaagcgggcgagaucguggc

SEQ ID NO: 4204656 - RNA, 76 nt, Molluscum contagiosum virus
gcgagcagaggcaugcuuuuuguucugcgcagggacgcgcuuuucgcacgagcgaaaacgcgugucuuccgcucgu

SEQ ID NO: 4204657 - RNA, 95 nt, Molluscum contagiosum virus
gcgcaggguccagacaaugcgugcgcccgucgccguagcagcuguagcagcggcgcagcuggcgcgcgucaaagagcuccuggaagaccuugugc

SEQ ID NO: 4204658 - RNA, 79 nt, Molluscum contagiosum virus
gcgccugccguucugcgcgcuagcgcagcugcgcugccuggagcagcgcgugagcuacgagcgccagcaaccggcgcgc

SEQ ID NO: 4204659 - RNA, 84 nt, Molluscum contagiosum virus
gcgcgaugaagaagaaguacacguaguugaggucgcugcucgaaagcacguuauuuuccugcagcgccuccagcgcgugcgcgc

SEQ ID NO: 4204660 - RNA, 75 nt, Molluscum contagiosum virus
gcgcuggcgugcgcagugcugcgcgacgucgucaaggauguagccuacguggcgggcaaggcgcgacaccuuugc

SEQ ID NO: 4204661 - RNA, 118 nt, Molluscum contagiosum virus
gcgcuuccuguuagcaaaccggcggcggcuacgcggcgacaucuucaugguuacggagcguagcuucgugcucuaggugugagggugcgccuuuccucucccggcagcaggaagacgc

SEQ ID NO: 4204662 - RNA, 77 nt, Molluscum contagiosum virus
gcggcagcgccacguccucgcacacgcggaucuccuugggcaugaugccuguggacuccuugugcagguagcgccgc

SEQ ID NO: 4204663 - RNA, 91 nt, Molluscum contagiosum virus
gcggcagcucgcugaagcugugcgcgcaggccacgggguuggcgugcucgcugacgccggcgcgcgugggcagcaucucgacgcuguccgc

SEQ ID NO: 4204664 - RNA, 83 nt, Molluscum contagiosum virus
gcggcgagacgaaguccagcacgcgcgcgugcgggaagcgcaugaccagcgucaggcacgcgcgcgugucuuccagccgcugc

SEQ ID NO: 4204665 - RNA, 65 nt, Molluscum contagiosum virus
gcgugcgcaccugcgcaagauguacggcgcaagcaggucuaucuacaacuucgcugugcguaugc

SEQ ID NO: 4204666 - RNA, 56 nt, Molluscum contagiosum virus
gcuccgcguggcagugcgcgggggaggcuccagagcgcgcagcgggcgcgcggggc

SEQ ID NO: 4204667 - RNA, 80 nt, Molluscum contagiosum virus
gcugcguggcauccgcgucccggcucugcucguccacgauaaucgucacgcgcacgucggcgcgcgcuagcuccagcagc

SEQ ID NO: 4204668 - RNA, 96 nt, Molluscum contagiosum virus
gcuucaggcgcagcagcucgcgcagcgcaucggggggaaacuccaaggccagcuccucgguguacugcuugcaguugagcgcgcgcgccaacaggc

SEQ ID NO: 4204669 - RNA, 61 nt, Molluscum contagiosum virus
ggaagaccgucgugcuguuguccacgcggugugucacgcgcaccagugugaccaggucucc

SEQ ID NO: 4204670 - RNA, 62 nt, Molluscum contagiosum virus
ggacaacgugcgccgcgcgccgcgcgugcgcacgcacuugcuggccgcccuggcgcuguucc

SEQ ID NO: 4204671 - RNA, 92 nt, Molluscum contagiosum virus
ggacucugacuucuggcgagaagcuuuccaugccgcucccuaguugcguguaggggccugcaguugagagccuucccgugccgcucauagcc

SEQ ID NO: 4204672 - RNA, 62 nt, Molluscum contagiosum virus
ggagcgagcucuucguguacuucggcagcucucugcacaggcacgagcuggagcuggccuuc

SEQ ID NO: 4204673 - RNA, 57 nt, Molluscum contagiosum virus
ggcgcacgcgagcacgccugcacgcgcacuugccuggcguccuucuuugcgugcgcc

SEQ ID NO: 4204674 - RNA, 77 nt, Molluscum contagiosum virus
ggcgccgcucuccucgggcaaggaggcgagcucggcacuagcucagcacgcgccgcagcucgggguccagcggagcc

SEQ ID NO: 4204675 - RNA, 63 nt, Molluscum contagiosum virus
ggcgcuggucacaugcacguacucgucguccaccacgaggagcuugguguuauugacggcguc

SEQ ID NO: 4204676 - RNA, 64 nt, Molluscum contagiosum virus
ggcggaugcggacacguagaccuugccauacaacgcacagcgccacuucugcgugacauccgcc

SEQ ID NO: 4204677 - RNA, 61 nt, Molluscum contagiosum virus
ggcucgaaaucugcgcgaggccauggccgagagccugggccgcacuucgcgcagcuuggcc

SEQ ID NO: 4204678 - RNA, 56 nt, Molluscum contagiosum virus
gggaccggcaccugcuacucccguacgcacggaaggagaaaagggguuguaguccc

SEQ ID NO: 4204679 - RNA, 85 nt, Molluscum contagiosum virus
gggcgacguugucgcgccacuugagacucgcauguccggcgauccaggacaucucgacguccacaguucuggccggcacacgccc

SEQ ID NO: 4204680 - RNA, 58 nt, Molluscum contagiosum virus
gggcguccgagggcgcgugccuuucccuggcguccgagggcgcgcgccuuucccgucc

SEQ ID NO: 4204681 - RNA, 61 nt, Molluscum contagiosum virus
gggcucgggguuggcuuugugcacgucugugugaaggaaugcuaguccuagccgcgagccc

SEQ ID NO: 4204682 - RNA, 100 nt, Molluscum contagiosum virus
gggggcgcggcaggaggauuggaggacgugcacgggccagcgcuaacgcgaggccccggcccgugcugucugugcauguagcagucguucuugcccuccu

SEQ ID NO: 4204683 - RNA, 71 nt, Molluscum contagiosum virus
ggguugguacccugcgagccauuaugcucggaguagccguugcucagcaugauguacuugaugaugagccc

SEQ ID NO: 4204684 - RNA, 55 nt, Molluscum contagiosum virus
uguccacguaccugucgagugcgcaaacacagcuucgagaggucaugaugguaca

SEQ ID NO: 4204685 - RNA, 74 nt, Molluscum contagiosum virus
ugugggucucgagccgcacaaagaacgcgcgucgaaggagcccgucuacauuuugcggcgcaucucgauucaca

SEQ ID NO: 4204686 - RNA, 59 nt, Molluscum contagiosum virus
uguugccgucgucgcugcaguuugcucgcgugagcaaggucaggccuugacggacaaca

SEQ ID NO: 4204687 - RNA, 63 nt, Molluscum contagiosum virus
uguacuccgacggcuucgaggccgagcccuccucgcugggcuccgugagcucguccgagccca

SEQ ID NO: 4204688 - RNA, 62 nt, Molluscum contagiosum virus
uucucgcagcuggaccugcgcgccgacgaccugagucggcgcggcgugcacgcuggcgagaa

SEQ ID NO: 4204689 - RNA, 94 nt, Molluscum contagiosum virus
uugcacgccccgcgccgcgcagaaaagccucgcaguugggcagucucaccucgcugccguccagguucagcgcggccugggggccgccgugcaa

SEQ ID NO: 4204690 - RNA, 59 nt, Molluscum contagiosum virus
aagaucacgcuggaccuggcgcagcuggagcacugcaccaucucguccuccaagaccuu

SEQ ID NO: 4204691 - RNA, 81 nt, Molluscum contagiosum virus
accagcgccaugcggaagggcgcgcgcagcaggcucgcgcgcgcaaagcgugccuccugcacgcgguccaucgcgcgcggu

SEQ ID NO: 4204692 - RNA, 65 nt, Molluscum contagiosum virus
acgccugagcacgugcgccgcuucgaggccaugacgggcgccgacacgcgcgugcucauccgcgu

SEQ ID NO: 4204693 - RNA, 75 nt, Molluscum contagiosum virus
acgcgucggacacguccagaaccuuggcacugcccuccaggcaacaguugaggugcucgaugagaguucgcgcgu

SEQ ID NO: 4204694 - RNA, 67 nt, Molluscum contagiosum virus
acguugugcgcaacgucuuccgcgcgcuuguagccgcgacgcaagcgcgaaacgguaagcucgacgu

SEQ ID NO: 4204695 - RNA, 64 nt, Molluscum contagiosum virus
agccgcgcugucgcugccuguaccccgagcccagcguggaggccaucgggcgcgaccugcggcu

SEQ ID NO: 4204696 - RNA, 56 nt, Molluscum contagiosum virus
agcgaauauggaccuugcacgcuuucguagacggggucgugagggacagagucgcu

SEQ ID NO: 4204697 - RNA, 61 nt, Molluscum contagiosum virus
agcgguagucggcgaugagcccggccagcgagcggugcuucauggcaacgacaaagcugcu

SEQ ID NO: 4204698 - RNA, 82 nt, Molluscum contagiosum virus
agugauugccaucgauuaugcuugaguuacaucgucaaauggacuuaccgaaaugcuagcgagcaaagucguggcaccgacu

SEQ ID NO: 4204699 - RNA, 84 nt, Molluscum contagiosum virus
cacgugcggagcacuucuccgaugggucggucgugacuccacgugcggagcacuucuccgaugggucggucgugacuccacgug

SEQ ID NO: 4204700 - RNA, 77 nt, Molluscum contagiosum virus
caucggagaagaaugcgaggcgcgacuggcacacggagcacguggugcacgaguccgcgggcggcuccuccacggug

SEQ ID NO: 4204701 - RNA, 58 nt, Molluscum contagiosum virus
caucuucuugaugaucuugcgcgccagcgugccggugcgcgaggucucgcagacgaug

SEQ ID NO: 4204702 - RNA, 59 nt, Molluscum contagiosum virus
cauugaggagguguuugcacccccccgggaaaaggagggaagcgugucacuuuccgaug

SEQ ID NO: 4204703 - RNA, 56 nt, Molluscum contagiosum virus
ccaagcgggcgcgccacucccugucuuucggcagcgaaacgcgugccucgcgccgg

SEQ ID NO: 4204704 - RNA, 69 nt, Molluscum contagiosum virus
ccaggaacgugaaguacuucucgauguugggaaugugguucuugaccuugaucgagaugugguucuugg

SEQ ID NO: 4204705 - RNA, 78 nt, Molluscum contagiosum virus
ccccggaggagaaaugucuugaucgugaagaggcaaggugcuguaacgcccacugacaaggucuuucucgcgucgggg

SEQ ID NO: 4204706 - RNA, 108 nt, Molluscum contagiosum virus
ccgugccguguccgcgacgcgcgcgcacgccgcgcgagcgcugggccgcacugcuaacggugcuggcgcgcgugcccugguccgcagucuugcuggcacuggcaaugg

SEQ ID NO: 4204707 - RNA, 55 nt, Molluscum contagiosum virus
cgagcgagcgaacucgacaacgcugacgggagucaggcgcgagggcgccuccucg

SEQ ID NO: 4204708 - RNA, 78 nt, Molluscum contagiosum virus
cgcagcuauacgccaucgagcccgagucuuccagcucggagacguacagcgacucggacucgagcgacucuggcugcg

SEQ ID NO: 4204709 - RNA, 83 nt, Molluscum contagiosum virus
cgcgagaaguucugcacagcacaggccccagcaacaagaguugucuuccaagcucuggcuugcgcuuagaccuuuacgucgcg

SEQ ID NO: 4204710 - RNA, 93 nt, Molluscum contagiosum virus
cgcgccgcgcguagugcucuuuguggaccgcggcgucaucgacaucaagcgcgcucugcgccagcgccgccaggacagcauugccgcggcgug

SEQ ID NO: 4204711 - RNA, 84 nt, Molluscum contagiosum virus
cgcgcuauucucguggcguugcugcugcgcgcgcuacugcgcgcacugcucgcgcacgcgcacgcgcacacgcugaguuacgug

SEQ ID NO: 4204712 - RNA, 130 nt, Molluscum contagiosum virus
cgcggacgcgggccuguccgcgggcgcacgcuuguccgcggacgcgggccuguccgcgggcgcacgcuuguccgcggacgcgggccuguccgcgggcgcacgcuuguccgcggacgcgggccuguccgcg

SEQ ID NO: 4204713 - RNA, 55 nt, Molluscum contagiosum virus
cgcggauggcggccagcguugcgccgaagucgucgucgccgcugcccgccaagcg

SEQ ID NO: 4204714 - RNA, 82 nt, Molluscum contagiosum virus
cgcuacacguuccgcgugcugcgcgccaguuuuccgugccccgagcugcguggcgcgggaagcgcgagcggcgcggacggcg

SEQ ID NO: 4204715 - RNA, 59 nt, Molluscum contagiosum virus
cgcugcgcgcggcgcuggcagguggcgcgaacuaaccaguucuagcagcugcgccagcg

SEQ ID NO: 4204716 - RNA, 55 nt, Molluscum contagiosum virus
cgcuuccuggacacgcgcaucguguacugccacauguccaagcugcaggaacgcg

SEQ ID NO: 4204717 - RNA, 60 nt, Molluscum contagiosum virus
cggagacucgcgcaacagcgcugcgcaggaucaugcaggcgcugggcggcgaguacuuug

SEQ ID NO: 4204718 - RNA, 99 nt, Molluscum contagiosum virus
cggagagacagcgcaaaggcggcucuccgcacacgugcucguugccgcaguggcgcgcaagacgaguagugcgcgagccgcgcgggcgcggauuuuccg

SEQ ID NO: 4204719 - RNA, 66 nt, Molluscum contagiosum virus
cgggcucggaaggugucgcgucugcguguuuugcgcugacggugcucccgacgccuucugagcccg

SEQ ID NO: 4204720 - RNA, 76 nt, Molluscum contagiosum virus
cguaaaggucuaagcgcaagccagagcuuggaagacaacucuuguugcuggggccugugcugugcagaacuucucg

SEQ ID NO: 4204721 - RNA, 62 nt, Molluscum contagiosum virus
cgucugcuuuugcgucgcgcguuaccagcgcauugacaccgacgcgcgcgcaaacgcggacg

SEQ ID NO: 4204722 - RNA, 61 nt, Molluscum contagiosum virus
cucgcgcaucugccgcgacuccuuugcgagcacuguacgcacgcacguggcgcugcgcgag

SEQ ID NO: 4204723 - RNA, 56 nt, Molluscum contagiosum virus
cucugugucggaauccucgcggacgcaccacgcgaaaagggucuggucgcacggag

SEQ ID NO: 4204724 - RNA, 70 nt, Molluscum contagiosum virus
cuucuccgacugcuucguuuucgaccuggugaguaucccgcgcagcacgcugagcguggcaguggggcag

SEQ ID NO: 4204725 - RNA, 67 nt, Molluscum contagiosum virus
cuucuggcgggcagcucugcuggcaggcauccuuggcucggcuugccggcguccucuucccgcggag

SEQ ID NO: 4204726 - RNA, 63 nt, Molluscum contagiosum virus
gaacgacacggagcggaucgugcuggagaucgacaagaucaaggucacgccgcccgaguauuc

SEQ ID NO: 4204727 - RNA, 59 nt, Molluscum contagiosum virus
gagauguuccccgagcucgaccuggaguucagcauccaguccaaguucaacaacgucuu

SEQ ID NO: 4204728 - RNA, 65 nt, Molluscum contagiosum virus
gagcgcgccgcuggaggcgagcguugcccauucugccgcgugacgucuucucgcgggacgggcuc

SEQ ID NO: 4204729 - RNA, 63 nt, Molluscum contagiosum virus
gaggacgugcgcgagaacuacuucuucggcgucucggacaucgacuucaucgaguacgucuuc

SEQ ID NO: 4204730 - RNA, 73 nt, Molluscum contagiosum virus
gcaacgagcucgcggcgcagcaugagcggcgagacuagugccuucgucgucaggcugggcgcgcgagcuaggc

SEQ ID NO: 4204731 - RNA, 57 nt, Molluscum contagiosum virus
gcacugccaugcccacauuggcgcccgcguucgggugcgugaucugcauggcuaggc

SEQ ID NO: 4204732 - RNA, 78 nt, Molluscum contagiosum virus
gcagcguguacucggccacgcgguggugcgugggcacuagagugccugccgcggccgcggcgcgaacgugcgcguugu

SEQ ID NO: 4204733 - RNA, 78 nt, Molluscum contagiosum virus
gccccgcgccgcgcagaaaagccucgcaguugggcagucucaccucgcugccguccagguucagcgcggccugggggc

SEQ ID NO: 4204734 - RNA, 77 nt, Molluscum contagiosum virus
gccugcugcacgcacugcguuacucgggcugcuaugccucgggcauggccaccgggaugcgcauggcgcgcacaugc

SEQ ID NO: 4204735 - RNA, 74 nt, Molluscum contagiosum virus
gccuguccgcgggcgcgggccuguccgcgggcgcacgcuuguccgcggacgcgggccuguccgcggaugcaggc

SEQ ID NO: 4204736 - RNA, 85 nt, Molluscum contagiosum virus
gccuuuccuuguugcggggggccuuuccuucggggugccuuuccucguucccggggugugccuuuuccuuguuacaggggugugc

SEQ ID NO: 4204737 - RNA, 66 nt, Molluscum contagiosum virus
gcgcacacgggcucgagcucggcguccggcacgcgguagcaaccguugggcucgauuucguugcgc

SEQ ID NO: 4204738 - RNA, 56 nt, Molluscum contagiosum virus
gcgccacgagcuugucccgccaggggcguccagcucgcuggacaaguugguggggc

SEQ ID NO: 4204739 - RNA, 56 nt, Molluscum contagiosum virus
gcgccgagcccgcggacacgacacgcuacaacgcgcuggucgacugggcgcggcgc

SEQ ID NO: 4204740 - RNA, 109 nt, Molluscum contagiosum virus
gcgcgcgcccagcgugugcggguagagcauguuggccagguagguguucucgaagcugagcucggggaaggccacuggcgagcguacgcccggcgcgccgggcgcgcgu

SEQ ID NO: 4204741 - RNA, 59 nt, Molluscum contagiosum virus
gcgcggcgggggagagcucgcgcacgaagauuaccacguucgggccugccagccggcgc

SEQ ID NO: 4204742 - RNA, 84 nt, Molluscum contagiosum virus
aaccguuguuuugucgcgugugcggggcagcaggcacuaggcgccggggcgcgcgcgcuuguuuggugucgcgcacgcacgguu

SEQ ID NO: 4204743 - RNA, 81 nt, Molluscum contagiosum virus
acggcuccuccaccagcgccuucuugaccagcaccagcaccguccagcugguguagaggaagcgcaggugcuugagcaugu

SEQ ID NO: 4204744 - RNA, 64 nt, Molluscum contagiosum virus
agacccaguggcguuugccgugacaagacacuguccuuccuccggcgaaaagccgcucgcgucu

SEQ ID NO: 4204745 - RNA, 83 nt, Molluscum contagiosum virus
agacucgugcugcagcagcagcgcuuucagguuuuugauucccauuaaaugaaagacgugcugcugcugcugggcaagccucu

SEQ ID NO: 4204746 - RNA, 63 nt, Molluscum contagiosum virus
agcacguccaugggcucguccuguacuggcguucccacgcccacagucaugugcccaugugcu

SEQ ID NO: 4204747 - RNA, 83 nt, Molluscum contagiosum virus
agcgcgcgccgguugcuggcgcucguagcucacgcgcugcuccaggcagcgcagcugcgcuagcgcgcagaacggcaggcgcu

SEQ ID NO: 4204748 - RNA, 130 nt, Molluscum contagiosum virus
agcugggcaucacgcuggucaaggaccacaugaacgaggugcgcgugaacaucggcagcgggcgccuagugcgcccguuccugguagugcaccagggcguucuggucauggacaccgucggugccgagcu

SEQ ID NO: 4204749 - RNA, 83 nt, Molluscum contagiosum virus
aguguccgugagugucgcgaccguagaagaugcuggcauguaccuugucacugucgcgacaacaacaagcuacacggucaacu

SEQ ID NO: 4204750 - RNA, 55 nt, Molluscum contagiosum virus
ccaggccugggcuucggaagcggccucugaggaguauccacgccaccaggccugg

SEQ ID NO: 4204751 - RNA, 55 nt, Molluscum contagiosum virus
ccaggccugguggcguggauacuccucagaggccgcuuccgaagcccaggccugg

SEQ ID NO: 4204752 - RNA, 95 nt, Molluscum contagiosum virus
ccucgugguggacgacgaguacgugcaugugaccagcgccgacauggacggcacgcacuacgcgcggcacgccuucgucagcuuuaacugcgcgg

SEQ ID NO: 4204753 - RNA, 77 nt, Molluscum contagiosum virus
cgaguaugggcagcagcgagagcaugguauccacguccacguccacguccaccgcgucugcgcgcgugcccgucucg

SEQ ID NO: 4204754 - RNA, 67 nt, Molluscum contagiosum virus
cgcaucagguagcgcucguccacgaagcgcgugaccagcgugacgucggacaggccuugcagacgcg

SEQ ID NO: 4204755 - RNA, 83 nt, Molluscum contagiosum virus
cgccagcagcagaggaguagcgugcgccugcagccuguuuuuaucgagccgcgcuucgagcacgcuuuccuuugcggcgagcg

SEQ ID NO: 4204756 - RNA, 74 nt, Molluscum contagiosum virus
cgccuggugcugcgcgacaugcugcccgcgcgcgacuacgcacuggcgauguccaugucgcgcaucaccgagcg

SEQ ID NO: 4204757 - RNA, 62 nt, Molluscum contagiosum virus
cgcggugcacgcguagcacggccagcaugaugucggccaucuggucgugcucgugcaccucg

SEQ ID NO: 4204758 - RNA, 57 nt, Molluscum contagiosum virus
cgcucacggccuucgcguuccggcggcuggaccugcgccagcgccuguccgugggcg

SEQ ID NO: 4204759 - RNA, 67 nt, Molluscum contagiosum virus
cggcgcgcugcuccgcucguucagcacguggaaguacuugucguaguuguagucgggcagcuugucg

SEQ ID NO: 4204760 - RNA, 66 nt, Molluscum contagiosum virus
cgggcucagaaggcgucgggagcaccgucagcgcaaaacacgcagacgcgacaccuuccgagcccg

SEQ ID NO: 4204761 - RNA, 77 nt, Molluscum contagiosum virus
cgugcgucacuuugggcuacagacaggcacgcgcgcgcgcaccgugcgugcgccgcagugcaccaucaccacgcgcg

SEQ ID NO: 4204762 - RNA, 95 nt, Molluscum contagiosum virus
cguuccacgauggaacggcgacuuguagugcccggaauuauguguaguuaaaugacggagccgcggcaguccgagcuguucaacaucguggcgcg

SEQ ID NO: 4204763 - RNA, 57 nt, Molluscum contagiosum virus
cucgcugcgcucgcgcgagggcaucuacggaaccugcuucuucgacgagcgcgcggg

SEQ ID NO: 4204764 - RNA, 77 nt, Molluscum contagiosum virus
gaaccacaugcaggcggagcagcugcugggacgcauuugccgcgaaaccgagcagccgcgccgcacugucuacguuu

SEQ ID NO: 4204765 - RNA, 63 nt, Molluscum contagiosum virus
gacgugcucgauagcgcagagcugcgugcgaaagacgcaacucgcucgcuuagggagcccguc

SEQ ID NO: 4204766 - RNA, 77 nt, Molluscum contagiosum virus
gacuucuccgcgcugcacuacaaccauggcgcgcucuuuugcaagcgcgaaaacacguuggaggacguggacaaguc

SEQ ID NO: 4204767 - RNA, 94 nt, Molluscum contagiosum virus
gagcagugccgccgcgcaaaagcacagcaggagcacgccuggcggcagcacgggcggaagcuccugcugguucagguagcgcgccgcaaagcuc

SEQ ID NO: 4204768 - RNA, 90 nt, Molluscum contagiosum virus
gcagacguagcucugcucgcucugcgagaagccgggguacgcgaugaacuuguucucgacggggccguaguagggcuuuacguacacggc

SEQ ID NO: 4204769 - RNA, 63 nt, Molluscum contagiosum virus
gcaggagcagcggcucguagcuggugaucauuuacuacccgcaaaagggcugcgcgucccggc

SEQ ID NO: 4204770 - RNA, 64 nt, Molluscum contagiosum virus
gcagucgcucuuccacaacaagcgccugcuggacgaggcggagcuuguguccaagcugggcugc

SEQ ID NO: 4204771 - RNA, 116 nt, Molluscum contagiosum virus
gcaugggcaccaugaccacguaggggcccagcacgcgcagcguguccauggucacgccaaaguccacgcacaugacgcgcgugcgcaugucggcgcguaggugcaugcggcccagc

SEQ ID NO: 4204772 - RNA, 99 nt, Molluscum contagiosum virus
gccccuccgcggccgcgagcggcagccauacgugcggcgcagggcgcgcacgcgcgugcaccuguuccagcacguagcgcucgcggaaguugcagaagc

SEQ ID NO: 4204773 - RNA, 62 nt, Molluscum contagiosum virus
gccgucugcgccggcagcgucucgcgcgaagacuuccugcuggucgucgccggcgccaaggu

SEQ ID NO: 4204774 - RNA, 78 nt, Molluscum contagiosum virus
gcgagaaguucugcacagcacaggccccagcaacaagaguugucuuccaagcucuggcuugcgcuuagaccuuuacgu

SEQ ID NO: 4204775 - RNA, 57 nt, Molluscum contagiosum virus
gcgaggaagcguuccgauucgcgacgucucccuccgcgcgcggacgcguuucuucgc

SEQ ID NO: 4204776 - RNA, 65 nt, Molluscum contagiosum virus
gcgccagcggcgccagcagcugcuggauacugcgguugcucauccaggcgccgcgcucggggcgc

SEQ ID NO: 4204777 - RNA, 69 nt, Molluscum contagiosum virus
gcgcccgcguacacgugcacgcgcacggguguggcccccgaguacgugagcacaguguagcgcgcgcgc

SEQ ID NO: 4204778 - RNA, 74 nt, Molluscum contagiosum virus
gcgcgagcccggaugcgugcacgucgagcacggccagcaagaggucgugcgccgcggcgcgcgccaacucgcgc

SEQ ID NO: 4204779 - RNA, 55 nt, Molluscum contagiosum virus
gcgcgaggcucgcuaugguuccagaagacuugucucucgagcacgggcuuugcgu

SEQ ID NO: 4204780 - RNA, 105 nt, Molluscum contagiosum virus
gcgcgcccagcgugugcggguagagcauguuggccagguagguguucucgaagcugagcucggggaaggccacuggcgagcguacgcccggcgcgccgggcgcgc

SEQ ID NO: 4204781 - RNA, 76 nt, Molluscum contagiosum virus
gcgcgcgcgcgcuacacugugcucacguacucgggggccacacccgugcgcgugcacguguacgcgggcgcugcgc

SEQ ID NO: 4204782 - RNA, 64 nt, Molluscum contagiosum virus
gcgcggugcacgcguagcacggccagcaugaugucggccaucuggucgugcucgugcaccucgu

SEQ ID NO: 4204783 - RNA, 69 nt, Molluscum contagiosum virus
gcgcugguugcgccuggaaaccacgcuauccgugcccgaguuugugauggagggucuaggcuucagugc

SEQ ID NO: 4204784 - RNA, 74 nt, Molluscum contagiosum virus
gcggcgcuaccugcacaaggaguccacaggcaucaugcccaaggagauccgcgugugcgaggacguggcgcugc

SEQ ID NO: 4204785 - RNA, 89 nt, Molluscum contagiosum virus
gcgugugcucuucuccccggacggugcggucuucgagcucgacgacuucccgcugcacgaggucuucgccgcgggagaacugcucacgc

SEQ ID NO: 4204786 - RNA, 56 nt, Molluscum contagiosum virus
gcucgaucagguucgcggagugagagacugcuugcacgcugcguacguggucuugc

SEQ ID NO: 4204787 - RNA, 71 nt, Molluscum contagiosum virus
gcucgcggugcagcugccgcagagccgcgaaagcgucgugcuccacgcgcagcuucucugcgaucgcgggc

SEQ ID NO: 4204788 - RNA, 56 nt, Molluscum contagiosum virus
gcugcgugcccgcgaugcgcgccuugaugggcucguagauggcaggcacgucgggc

SEQ ID NO: 4204789 - RNA, 109 nt, Molluscum contagiosum virus
gcuucguccgcuacgcugugcacgcacgcgguugcgccuccgcguacgaaacacagguacgacaaguagcgcgcggccauguguacgcagugccggauggcggggaagc

SEQ ID NO: 4204790 - RNA, 63 nt, Molluscum contagiosum virus
ggcaaaagggcucugccaccaugcgcacagcacuucuuugcgcauuggcagcgcuuuguugcc

SEQ ID NO: 4204791 - RNA, 55 nt, Molluscum contagiosum virus
ggccuucgcugccuucgaagagaaugacuucucccgaaaagggugguagggggcu

SEQ ID NO: 4204792 - RNA, 99 nt, Molluscum contagiosum virus
ggcgcgccgacgccgccggggcgcgccgacgucaccgggcgcgccaacgccgccgggcgcgccgacgucaccgggcgcgccaacgcugccgggcgcgcc

SEQ ID NO: 4204793 - RNA, 64 nt, Molluscum contagiosum virus
ggcggaugucacgcagaaguggcgcugugcguuguauggcaaggucuacguguccgcauccgcc

SEQ ID NO: 4204794 - RNA, 74 nt, Molluscum contagiosum virus
ggcggcggcagucggcgggcacggccagcgucuucagcacgaagaugaccucguucccgucgaccgcgcgcgcc

SEQ ID NO: 4204795 - RNA, 89 nt, Molluscum contagiosum virus
ggcuggcgugcgcgucauuaaacuccaggaugcugucgaaauucucguagacggcauacgccugcagcagcaaugugcacacggcggcc

SEQ ID NO: 4204796 - RNA, 69 nt, Molluscum contagiosum virus
ggcugguguuuucguccauccacugcugcacguccacguaauugcagagaaacauguagaaggccagcu

SEQ ID NO: 4204797 - RNA, 69 nt, Molluscum contagiosum virus
gggacgcgucucaacgugggagucacagcccuggucgcaggcgaggacccccaucuugacacacguccc

SEQ ID NO: 4204798 - RNA, 88 nt, Molluscum contagiosum virus
gggcaucccgccgcugcgcuugcucacgcugcgcucggcgcgcgccgcgcgcgucgucgccguguuggaagucguggccguagugcuc

SEQ ID NO: 4204799 - RNA, 81 nt, Molluscum contagiosum virus
gggccaacguuccgucgugugcuugcggcucaguccaguuucgcguuugcaggccagugcgacguugcgugcuuguggccc

SEQ ID NO: 4204800 - RNA, 63 nt, Molluscum contagiosum virus
ggggacguccugcgccaugcgcagucucgugccgcgcugaguauggacgugggcggcagcccc

SEQ ID NO: 4204801 - RNA, 58 nt, Molluscum contagiosum virus
ggggucgcgcgagucgggcgggaaguagggcagcacucggcccagcacgcgcggcucc

SEQ ID NO: 4204802 - RNA, 56 nt, Molluscum contagiosum virus
ggugcacgcguagcacggccagcaugaugucggccaucuggucgugcucgugcacc

SEQ ID NO: 4204803 - RNA, 60 nt, Molluscum contagiosum virus
guacgcgcgagcgagcgccggggcucugcgcagcgugcuggcguucguucgcgccagugc

SEQ ID NO: 4204804 - RNA, 78 nt, Molluscum contagiosum virus
guaguggcggcaaaagggcucugccaccaugcgcacagcacuucuuugcgcauuggcagcgcuuuguugccucaguac

SEQ ID NO: 4204805 - RNA, 118 nt, Molluscum contagiosum virus
guccacgguuggcgccaucgacgaccucaagucucuguucgagaaccugcacgcgacgcugcgacgcagccgcgagcgcuugcgaccugaagacgaugacgaugacgacgacgaggac

SEQ ID NO: 4204806 - RNA, 117 nt, Molluscum contagiosum virus
guccagcaucccgcgcaugagcaccgagucggaccgcaucucggccaccagguacgacaugucuggccacguggagaccggcggcucggaaugcucgugcucgucgaugaccugcgc

SEQ ID NO: 4204807 - RNA, 105 nt, Molluscum contagiosum virus
gucgcgcagguugugcucgaugacgcggcgguugcgcgggcagagcaguggcagugcgaacucaggcgccagcucgucgcgcaugugcagcaccagcuuggugau

SEQ ID NO: 4204808 - RNA, 57 nt, Molluscum contagiosum virus
gugccgucagcacccaccaagaacuucucgaaguuccaggccacgucguugcggcac

SEQ ID NO: 4204809 - RNA, 77 nt, Molluscum contagiosum virus
guggagaugcucauggacgcgcucgggcuuccgcgcacucuagcggucucgcgaguugcguucgugcgcgcacucac

SEQ ID NO: 4204810 - RNA, 79 nt, Molluscum contagiosum virus
guugcgcucgaggguggccacgucgagucuguccaggaaauccaccagguccguguacccgcgcucguggcacugcaac

SEQ ID NO: 4204811 - RNA, 58 nt, Molluscum contagiosum virus
ucggaggccgacuaucuucuuuacggaacgcccugguucuggaagaaucggacucgga

SEQ ID NO: 4204812 - RNA, 84 nt, Molluscum contagiosum virus
ucuugcgugccuucgccaaugacggcgucucucgaacaccgacaaggagggagagcugcccgaguuucggaagagcaagcgaga

SEQ ID NO: 4204813 - RNA, 80 nt, Molluscum contagiosum virus
ugaagcuguucauccggaggauccgcauccucuaggcgcagccuccgguuuucgcgggagcggccuccggagaagcuuua

SEQ ID NO: 4204814 - RNA, 90 nt, Molluscum contagiosum virus
ugcgucuuuacacagcaacgagcucgcggcgcagcaugagcggcgagacuagugccuucgucgucaggcugggcgcgcgagcuaggcgcg

SEQ ID NO: 4204815 - RNA, 69 nt, Molluscum contagiosum virus
ugcugcagcagcagcgcuuucagguuuuugauucccauuaaaugaaagacgugcugcugcugcugggca

SEQ ID NO: 4204816 - RNA, 76 nt, Molluscum contagiosum virus
uggcacuggcgcgcacgcgcacgcucucgcuggcuccgcuggaccccgagcugcggcgcgugcugagcuagugccg

SEQ ID NO: 4204817 - RNA, 61 nt, Molluscum contagiosum virus
ugucaagcacggaaaggaagugcucgagagccucccgcauuucccugccggugcguuggca

SEQ ID NO: 4204818 - RNA, 66 nt, Molluscum contagiosum virus
uugcgagcgguguugcugacgacugcggcgagaagaagcugucggucucgagcgccgccaucacga

SEQ ID NO: 4204819 - RNA, 129 nt, Molluscum contagiosum virus
uuugccacggcgagucacgucucugaaggcuuggcuucucgacuggagggggcaacgccguucgugccguguccguuguuccagcuagaagaggccgucccggcgacuucagagggaagcucgcaagaa

SEQ ID NO: 4204820 - RNA, 74 nt, Molluscum contagiosum virus
uuuuccaugcgcaacgugcugcguagccuggccuuccgcgacuacgcgcugcgcggcgcggcgcgcguggagga

SEQ ID NO: 4204821 - RNA, 60 nt, Molluscum contagiosum virus
gcgcgggcgggcggugccucgcaauguguccgcgucgcuagcagugccgccuccucacgc

SEQ ID NO: 4204822 - RNA, 86 nt, Molluscum contagiosum virus
gcgcguccucggccagagccuucucgguguagaugugguacuuguugugcacgcuguccaggcgcugcacgaacucacggaugcgc

SEQ ID NO: 4204823 - RNA, 77 nt, Molluscum contagiosum virus
gcgcgugagccaauggacgccggggggcgccaaguccgagcaagcgggccaguacuacucggcgcuaugccgcgugc

SEQ ID NO: 4204824 - RNA, 80 nt, Molluscum contagiosum virus
gcggcuggaagacacgcgcgcgugccugacgcuggucaugcgcuucccgcacgcgcgcgugcuggacuucgucucgccgc

SEQ ID NO: 4204825 - RNA, 113 nt, Molluscum contagiosum virus
gcgucacgugcagcuugcuacgcaccgagacaucagcgcgaucucgaucgaacacgcagacgggcgucucgauaaucgcgacugguacuuccccguguacaaacucgugacgc

SEQ ID NO: 4204826 - RNA, 83 nt, Molluscum contagiosum virus
gcgugaacgcgcgcgugcgguguugcucgaagggcuccacgagcaauucgcuuugcagcccgcacucacgcacgcccacaugc

SEQ ID NO: 4204827 - RNA, 55 nt, Molluscum contagiosum virus
gcucagcauggaguuuugcaacgcguagucguacagcagguccuccgugcugggc

SEQ ID NO: 4204828 - RNA, 62 nt, Molluscum contagiosum virus
gcugcacaugugcgugcaccucaagaagacgcagagcgagggcgacgcguacguguccaugc

SEQ ID NO: 4204829 - RNA, 56 nt, Molluscum contagiosum virus
gcugcacgggucguagucgugcgcgagugggaugcgcagggugcgcucguaguagc

SEQ ID NO: 4204830 - RNA, 57 nt, Molluscum contagiosum virus
gcugcgaguacuuccuggaaugguucgugcgcaaccacuucgagaugaucucgcggc

SEQ ID NO: 4204831 - RNA, 82 nt, Molluscum contagiosum virus
ggagccguacaugaucagcguuuaccccgagggccgcgucuucuuugacgcggacucgggcacaggcgugaucgcggacuuc

SEQ ID NO: 4204832 - RNA, 64 nt, Molluscum contagiosum virus
ggagcgagauggcguugaugcugcgcagcgucucagcgaugaggcgcggcgccgucuuguugcc

SEQ ID NO: 4204833 - RNA, 57 nt, Molluscum contagiosum virus
ggaguagcgugcgccugcagccuguuuuuaucgagccgcgcuucgagcacgcuuucc

SEQ ID NO: 4204834 - RNA, 56 nt, Molluscum contagiosum virus
ggcaacgcaugcagucgacggcgcuguuucgcgcgcacuccagcagcaguguugcc

SEQ ID NO: 4204835 - RNA, 59 nt, Molluscum contagiosum virus
ggcagcgcaagcgcaggcaguacgcggccacguacgcgcgcagcagugccagcgcuguc

SEQ ID NO: 4204836 - RNA, 87 nt, Molluscum contagiosum virus
ggcaggaggauuggaggacgugcacgggccagcgcuaacgcgaggccccggcccgugcugucugugcauguagcagucguucuugcc

SEQ ID NO: 4204837 - RNA, 74 nt, Molluscum contagiosum virus
ggcgcgcgcggucgacgggaacgaggucaucuucgugcugaagacgcuggccgugcccgccgacugccgccgcc

SEQ ID NO: 4204838 - RNA, 61 nt, Molluscum contagiosum virus
gggcagcguguagcggcacaccagcaggcacucgacucgcugcgugcgcagcccgcugccc

SEQ ID NO: 4204839 - RNA, 58 nt, Molluscum contagiosum virus
gggcuugucggaauuucugucugcgucccgagugacgcucgcguucucggcaaugccc

SEQ ID NO: 4204840 - RNA, 98 nt, Molluscum contagiosum virus
gggggcgcggcaggaggauuggaggacgugcacgggccagcgcuaacgcgaggccccggcccgugcugucugugcauguagcagucguucuugcccuc

SEQ ID NO: 4204841 - RNA, 122 nt, Molluscum contagiosum virus
gguccugcuucuugagcaugugagugguuaauggcucuuugggcgcgggcaugagaaagacgugcuccgcgggcgccauaaagagcagguuucccaguaccagcaacucucgcaguaguucc

SEQ ID NO: 4204842 - RNA, 60 nt, Molluscum contagiosum virus
gucugcuuuugcgucgcgcguuaccagcgcauugacaccgacgcgcgcgcaaacgcggac

SEQ ID NO: 4204843 - RNA, 124 nt, Molluscum contagiosum virus
gugggggcgccugcucaucccgcggcugcagaaccgcgcgcuguacagcuaccuguuccuguccaguuaccaccugugcgaccuguuccuggagcugcgcgagcugggcucggcgagcuuccgc

SEQ ID NO: 4204844 - RNA, 76 nt, Molluscum contagiosum virus
uacugcaacguggcgccgcugcuggaacaggugcgcaagcauuuccacuguacggagcgcgucuauccugucagua

SEQ ID NO: 4204845 - RNA, 66 nt, Molluscum contagiosum virus
ucacguagcgcucgcucgccgccgccacuuugucuuugaggauguaggcgagcauguucugcgcga

SEQ ID NO: 4204846 - RNA, 60 nt, Molluscum contagiosum virus
ucucgccagcgugcacgccgcgccgacucaggucgucggcgcgcagguccagcugcgaga

SEQ ID NO: 4204847 - RNA, 92 nt, Molluscum contagiosum virus
ucugaaggcuuggcuucucgacuggagggggcaacgccguucgugccguguccguuguuccagcuagaagaggccgucccggcgacuucaga

SEQ ID NO: 4204848 - RNA, 70 nt, Molluscum contagiosum virus
ugcucuuccccgagcucuucagcagcugcaccgaacgucagaaguucagcugcgcgggcuccgacgagca

SEQ ID NO: 4204849 - RNA, 55 nt, Molluscum contagiosum virus
ggucgagucguucucgcgguacuugaagaccagguccugcgagcucgacaugucc

SEQ ID NO: 4204850 - RNA, 57 nt, Molluscum contagiosum virus
ggucucuaccgccuugcugagcacgauggggcgcucggggaagagcagguggaugcc

SEQ ID NO: 4204851 - RNA, 85 nt, Molluscum contagiosum virus
ggugcggcgccuggaagcaagcgccgugaacugugcgacgcccagaggcgagcgccgugaacugugcagcgccaaggugaacgcc

SEQ ID NO: 4204852 - RNA, 59 nt, Molluscum contagiosum virus
ggugcucguacuccucaugaaugcgagcagcuggcucccuuggacggaaugcgagcgcc

SEQ ID NO: 4204853 - RNA, 124 nt, Molluscum contagiosum virus
gguucccccgcgagcggggcccugcgggacgcgucucaacgugggagucacagcccuggucgcaggcgaggacccccaucuugacacacgucccccgacgcagacacuugcgcgugacgagacc

SEQ ID NO: 4204854 - RNA, 70 nt, Molluscum contagiosum virus
guacagcggcuacugcaugcugugcuucguggagcagcggcuggacgacgugcagcaugccacgcuguac

SEQ ID NO: 4204855 - RNA, 88 nt, Molluscum contagiosum virus
gucgcgaaaggcgcuugauccugcgauggccgugaucgcgcgcgugagcuacagccucuacacgcagaacgagaucaacgccaacgac

SEQ ID NO: 4204856 - RNA, 78 nt, Molluscum contagiosum virus
gucggcgggcucggaaggugucgcgucugcguguuuugcgcugacggugcucccgacgccuucugagcccgagcugac

SEQ ID NO: 4204857 - RNA, 117 nt, Molluscum contagiosum virus
gucguguccgcggcgggcgcgggcgcggguccgugcacgggcucgagcgcgggcccgggcucgcgcucuuccguccgugcccggcuugugaacgcggcaugcgcgcggggccgcgac

SEQ ID NO: 4204858 - RNA, 102 nt, Molluscum contagiosum virus
gugcacguuuacguagcggcgcucgggcggguuguuggcguggcugugcaggcggauggcgcgcccgaugaucugcuugagcgacgccucguuccaugucau

SEQ ID NO: 4204859 - RNA, 102 nt, Molluscum contagiosum virus
gugccgcgagagcucacgcgcucacgcgacgcuggcacgcucacggugcacgcgcuuugcgugcccgagcacgcgugugugcgcgugaccgcuuucgugcac

SEQ ID NO: 4204860 - RNA, 108 nt, Molluscum contagiosum virus
gugcgcgcggcccgcguccgcagcucccugcgcguacgccgcaugguugagaaugugcuuggucauguggaugucgcaguagaugaacuucuugaugcccgcgcgugc

SEQ ID NO: 4204861 - RNA, 78 nt, Molluscum contagiosum virus
gugugcuuguugcuaggcguguccgcagcugugcgcgugcuugccgccgcacagcugcgggcugcggcuacgugccac

SEQ ID NO: 4204862 - RNA, 55 nt, Molluscum contagiosum virus
guugguguggaaaaagacggucuugcccgcgggcacgccgucgaugcgcaccagc

SEQ ID NO: 4204863 - RNA, 67 nt, Molluscum contagiosum virus
ucgacggcgccucgagcgcgcuggacuugcgcgagcgagugaaggucgcguuccaggugcugggcga

SEQ ID NO: 4204864 - RNA, 56 nt, Molluscum contagiosum virus
ucgcguggaacuugacgccguagcgccgcagcagcugcggcuugggcaccgcgcgg

SEQ ID NO: 4204865 - RNA, 69 nt, Molluscum contagiosum virus
ucgcgugugcggggcagcaggcacuaggcgccggggcgcgcgcgcuuguuuggugucgcgcacgcacgg

SEQ ID NO: 4204866 - RNA, 70 nt, Molluscum contagiosum virus
ugccagcagcauuuuggugggcacgcagaccacggcgcgccgccggugcgugcccagcagguagcuggca

SEQ ID NO: 4204867 - RNA, 56 nt, Molluscum contagiosum virus
ugcgcgcguggugugcuaccagcuccucgggcaugauggacauguacacgcgcgcg

SEQ ID NO: 4204868 - RNA, 58 nt, Molluscum contagiosum virus
ugcugcacgggucguagucgugcgcgagugggaugcgcagggugcgcucguaguagca

SEQ ID NO: 4204869 - RNA, 130 nt, Molluscum contagiosum virus
uguagcgguugaccagcuccacguugggguugucgggcgcuuuguaguugcgguggugcauccugcugaguaggaacauuucgagcggcugcgcgcgcgccgcgaacucggcgaacaggucuacuuccag

SEQ ID NO: 4204870 - RNA, 79 nt, Murray Valley encephalitis virus
gggcuucaucuccauuguuggcagggacuccucuuccgagacgguucugggaggcuuuccaaccguggagaaucagcuu

SEQ ID NO: 4204871 - RNA, 59 nt, Murray Valley encephalitis virus
cugcucguugcaagcacugcgcgaucucauugcucauuuuuacgcuugccacgaaccag

SEQ ID NO: 4204872 - RNA, 81 nt, Murray Valley encephalitis virus
agcugcuacagcuuggaugguguugcgagcaauggcuuuuccgucaaccucagcaauagccaugcccaugcuagcaaugcu

SEQ ID NO: 4204873 - RNA, 72 nt, Murray Valley encephalitis virus
gcuuuugcuaagcaugccgugucccugacguuccauccugagccaggggauauucgugcucuuccaaucagc

SEQ ID NO: 4204874 - RNA, 92 nt, Norwalk virus
ggugugccauccaauucaguaagguugauuacagugccauuggaggucccucuuaucuuggcaacaugugacaaugaaacugggguggugcc

SEQ ID NO: 4204875 - RNA, 58 nt, Poliovirus
ucucaccuccugggagucaacugcuuggagcaagucauugauacauucaggaggggga

SEQ ID NO: 4204876 - RNA, 65 nt, Poliovirus
cagcccugcuugguucgaggcacuaaagauggugcuugagaaaaucggauucggagacagaguug

SEQ ID NO: 4204877 - RNA, 78 nt, Poliovirus
ugaccggcaggcccuguaagcguggcagggugauguuucuuaauccauugaacucacagcacauaggggcuaugguca

SEQ ID NO: 4204878 - RNA, 69 nt, Poliovirus
aacuuuaagagaugcuguccuuuagugugugguaaggcaauucaauuaauggacaaaucuuccagaguu

SEQ ID NO: 4204879 - RNA, 65 nt, Respiratory syncytial virus
guuaacauauuuuuugauuuuaggcauguuagacuacaugccuugauuucacagggugugguuac

SEQ ID NO: 4204880 - RNA, 59 nt, Rubella virus
cguugcccuggcgcugacacgcgaccucgccaucgucagccugacccgggccuccgacg

SEQ ID NO: 4204881 - RNA, 57 nt, Rubella virus
uggcgagccagagggccgaggcuggggagcaagucgcgcgucccauggggcucacca

SEQ ID NO: 4204882 - RNA, 72 nt, Rubella virus
cuucccaggggggacggcgccgagguccucgccauugacggugagauggcaauugccucccccgggggcaag

SEQ ID NO: 4204883 - RNA, 58 nt, Rubella virus
gcgagccagcaguuaugcaccucccauacaccgauggcgacgugccacagcugaucgc

SEQ ID NO: 4204884 - RNA, 58 nt, Rubella virus
gcgcacgccuuuggggaccaugcgcauggccaugcacauggccacggugguguugugc

SEQ ID NO: 4204885 - RNA, 56 nt, Rubella virus
gcucgccgccuaccgccgcaucuacaucgaugaggcguucacucucggcggcgagu

SEQ ID NO: 4204886 - RNA, 64 nt, Rubella virus
ucgaggucgacuucacugaguucgacaugaaccagacccucgcuacucgggacgucgagcucga

SEQ ID NO: 4204887 - RNA, 76 nt, Rubella virus
cguugcgcaggcugcgcgcgccugcggcgccuacacgagugccgggugccccaagugcgccuacggccgcgcccug

SEQ ID NO: 4204888 - RNA, 74 nt, Rubella virus
gcccgcgagcgugaugcuguggcacagggcguucuugaacuugaacacgcgcucgcuguaguacgcgucggggc

SEQ ID NO: 4204889 - RNA, 85 nt, Rubella virus
gcggcgaaguccucaugagugcgggcuucgcucagggcgcggccguaggcgcacuuggggcacccggcacucguguaggcgccgc

SEQ ID NO: 4204890 - RNA, 57 nt, Rubella virus
ggugccgccaugauggccgucgugcccgaggaacggcagcugaugguggugguggcc

SEQ ID NO: 4204891 - RNA, 63 nt, SARS coronavirus
gugaugucaagaaaguuaaaagcauccaaugaugagugcccuuaacaauuuucuugaacuuac

SEQ ID NO: 4204892 - RNA, 56 nt, SARS coronavirus
guuuccaucauuaauaaugcuguuuacacaaagguagaugguauugauguggagau

SEQ ID NO: 4204893 - RNA, 64 nt, SARS coronavirus
uaccaguguguguacacaacaucuucacacaguuggugauugguuguccuccacuugcuaggua

SEQ ID NO: 4204894 - RNA, 69 nt, SARS coronavirus
augucugaggcaaaauguuggacugagacugaccuuacuaaaggaccucacgaauuuugcucacagcau

SEQ ID NO: 4204895 - RNA, 83 nt, SARS coronavirus
gaagaacaagcacucucaguagguuucuuggcaaugucagucauugugcagacaccuauuguagauacaugugcuggggcuuc

SEQ ID NO: 4204896 - RNA, 86 nt, SARS coronavirus
ucaugaugaccacacaaggcagaugggcuauguaaacguuuucgcaauuccguuuacgauacauagucuacucuugugcagaauga

SEQ ID NO: 4204897 - RNA, 92 nt, SARS coronavirus
gagcucauucauucugucuuucucuuaauggugaagcaaaguauuaaaaauacuagagcagcaacaaugagaaaaaguggcgaguagagcuc

SEQ ID NO: 4204898 - RNA, 56 nt, SARS coronavirus
gcagcuacugaaaagcauguagugcguuuaucuagcaauaaauugccagaagcugc

SEQ ID NO: 4204899 - RNA, 64 nt, Seoul virus
uaguaguagacuccgcaagaaacagcaguuaaauaacagcaggaucauguggaguuugcuauua

SEQ ID NO: 4204900 - RNA, 67 nt, Seoul virus
gucaguauuugcuuaucauuuuuugcuugcuauuugccaaaagaugaaauuaugugcaaucuuugac

SEQ ID NO: 4204901 - RNA, 59 nt, Sin Nombre virus
cguaggaagacaauguguuugauuacaggcuaaaucauaacaaauuacugucuuccuug

SEQ ID NO: 4204902 - RNA, 81 nt, Sin Nombre virus
gucuuuauuaagucaagaacacaaaaaagguaauauaaaucaagcuuauaagaucacauuugauguuguggcuguaaagac

SEQ ID NO: 4204903 - RNA, 81 nt, Sin Nombre virus
uuuugugcuaggcuuauaagcaaugcuuuuauuauauuauauaaauauacuucuaaggcacucuuaaacggccgcucaaag

SEQ ID NO: 4204904 - RNA, 60 nt, Tula virus
cagcaugugcaauuagacauucuguuauaucucuuaacaaaugccccauaugccaugcug

SEQ ID NO: 4204905 - RNA, 94 nt, Tula virus
uaguaguagaccgagaagacucaaacacagacaaaacauacuucuuuauuccaguuuucucuguguuugcuucuucuugcggagucuacuacua

SEQ ID NO: 4204906 - RNA, 85 nt, Tula virus
guuuuuugaaaggccauuuaagagugcacuugauguauaccuguauacuauuauaaaaacacuacuuguaagccuugcacaaaau

SEQ ID NO: 4204907 - RNA, 56 nt, Vaccinia virus
gcuuugaguuuuguugaaucgaugagugaaguaucaucgguugcaccuucagaugc

SEQ ID NO: 4204908 - RNA, 53 nt, Vaccinia virus
agagaaaacaaaacgaggauaguugauuuauuacuuagcuaccaucccacucu

SEQ ID NO: 4204909 - RNA, 79 nt, Vaccinia virus
ggcaaaucuuaucauuggucgguguuuggucuugcuuugugacuuugauaauaacaucgauucccauaugauguuuguu

SEQ ID NO: 4204910 - RNA, 62 nt, Vaccinia virus
uggaaaguguaaagacaacgaauacaaacgccauaauuuguguccgggaacauacgcuucca

SEQ ID NO: 4204911 - RNA, 73 nt, Vaccinia virus
uuuaugauauggguagaguuuuuguccccgcuccuuuuggaggaucgcaagaauuuauuucuaaaucuaugag

SEQ ID NO: 4204912 - RNA, 82 nt, Variola virus
cauauuuguaacuucgucguaaagcguuaaaucaauagaauaaaccauuuuguggugcaacuuuuuacgaacuaguuguaug

SEQ ID NO: 4204913 - RNA, 77 nt, West Nile virus
gauccuguguucuagcaccaccagccaccuaugucggcgcacugugccguguggcugguugugcagagcagaagauc

SEQ ID NO: 4204914 - RNA, 22 nt, Vaccinia virus
aaacaaaacgaggauaguugau

SEQ ID NO: 4204915 - RNA, 22 nt, Vaccinia virus
ugauauggguagaguuuuuguc

SEQ ID NO: 4204916 - RNA, 22 nt, Homo sapiens
ucacugcaaccuccaccuccca

SEQ ID NO: 4204917 - RNA, 22 nt, Homo sapiens
ucacugcaaccuccaccucccg

SEQ ID NO: 4204918 - RNA, 22 nt, Homo sapiens
ucacugcaaccuccaccuccug

SEQ ID NO: 4204919 - RNA, 22 nt, Homo sapiens
ucacugcaaccuccaccuucag

SEQ ID NO: 4204920 - RNA, 22 nt, Homo sapiens
ucacugcaaccuccaccuuccg

SEQ ID NO: 4204921 - DNA, 18 bp, Homo sapiens
tttaaccgcatccttctc

SEQ ID NO: 4204922 - DNA, 20 bp, Homo sapiens
tactaatacgactcactaaa

SEQ ID NO: 4204923 - RNA, 30 nt, Homo sapiens
gacuagcuggaauucaaggaugcgguuaaa

SEQ ID NO: 4204924 - DNA, 30 bp, Homo sapiens
cagccaacgctgcagatacgactcactaaa

SEQ ID NO: 4204925 - DNA, 50 bp, Homo sapiens
  misc_feature (50)..(50): n is a, c, g or t
  misc_feature (33)..(33): n=i
  misc_feature (37)..(38): n=i
  misc_feature (42)..(43): n=i
  misc_feature (47)..(48): n=i
aattaaccctcactaaaggctgcaggtgcaggngggnngggnngggnngn

SEQ ID NO: 4204926 - DNA, 20 bp, Homo sapiens
ggaattcaaggatgcggtta

SEQ ID NO: 4204927 - RNA, 10 nt, Homo sapiens
  misc_feature (3)..(4): n is a, c, g or u
  misc_feature (8)..(9): n is a, c, g or u
ggnngggnng

SEQ ID NO: 4204928 - RNA, 12 nt, Homo sapiens
cgacucacuaaa

SEQ ID NO: 4204929 - DNA, 40 bp, Homo sapiens
taatacgactcactataggcccttattagaggattctgct

SEQ ID NO: 4204930 - DNA, 41 bp, Homo sapiens
aattaaccctcactaaaggtttttttttcctgagacagagt

SEQ ID NO: 4204931 - DNA, 42 bp, Homo sapiens
taatacgactcactatagggtgaggtagtaagttgtattgtt

SEQ ID NO: 4204932 - DNA, 41 bp, Homo sapiens
aattaaccctcactaaagggaaagtagtaagttgtatagtt

SEQ ID NO: 4204933 - DNA, 20 bp, Homo sapiens
gaggcaggagaattgcttga

SEQ ID NO: 4204934 - DNA, 39 bp, Homo sapiens
aattaaccctcactaaaggcctgagacagagtcttgctc

SEQ ID NO: 4204935 - DNA, 20 bp, Homo sapiens
attaaccctcactaaaggga

SEQ ID NO: 4204936 - DNA, 20 bp, Homo sapiens
taatacgactcactataggg

SEQ ID NO: 4204937 - DNA, 25 bp, Homo sapiens
  misc_feature (1)..(1): r is a or g
  misc_feature (3)..(3): r is a or g
  misc_feature (5)..(5): r is a or g
rtrgrgcctatagtgagtcgtatta

SEQ ID NO: 4204938 - DNA, 22 bp, Homo sapiens
  misc_feature (17)..(17): r is a or g
  misc_feature (19)..(19): r is a or g
  misc_feature (21)..(21): r is a or g
aaaggaggagctctagrartra

SEQ ID NO: 4204939 - DNA, 25 bp, Homo sapiens
  misc_feature (20)..(20): r is a or g
  misc_feature (22)..(22): r is a or g
  misc_feature (24)..(24): r is a or g
cctaggaggaggacgtctgrcrarg

SEQ ID NO: 4204940 - DNA, 25 bp, Homo sapiens
  misc_feature (1)..(1): r is a or g
  misc_feature (3)..(3): r is a or g
  misc_feature (5)..(5): r is a or g
rcrcrtatagtgagtcgtattatct

SEQ ID NO: 4204941 - DNA, 22 bp, Homo sapiens
taatacgactcactataggcca

SEQ ID NO: 4204942 - DNA, 34 bp, Homo sapiens
gctagcactagttaatacgactcactataggcca

SEQ ID NO: 4204943 - DNA, 19 bp, Homo sapiens
aaaggaggagctctagata

SEQ ID NO: 4204944 - DNA, 29 bp, Homo sapiens
tgacctgcagaaaggaggagctctagata

SEQ ID NO: 4204945 - DNA, 24 bp, Homo sapiens
atcctaggaggaggacgtctgcag

SEQ ID NO: 4204946 - DNA, 28 bp, Homo sapiens
gctctaggataatacgactcactatagg

SEQ ID NO: 4204947 - DNA, 12 bp, Homo sapiens
tttaaccgcatc

SEQ ID NO: 4204948 - DNA, 12 bp, Homo sapiens
aattgcttgaac

SEQ ID NO: 4204949 - DNA, 10 bp, Homo sapiens
actgcactcc

SEQ ID NO: 4204950 - DNA, 10 bp, Homo sapiens
cactgcactc

SEQ ID NO: 4204951 - DNA, 11 bp, Homo sapiens
ctagactgaag

SEQ ID NO: 4204952 - DNA, 11 bp, Homo sapiens
gaagtttgaag

SEQ ID NO: 4204953 - DNA, 10 bp, Homo sapiens
tcactgcaac

SEQ ID NO: 4204954 - DNA, 12 bp, Homo sapiens
tctaagagaaag

SEQ ID NO: 4204955 - DNA, 10 bp, Homo sapiens
gggcagtgga

SEQ ID NO: 4204956 - DNA, 12 bp, Homo sapiens
aattgcttgaac

SEQ ID NO: 4204957 - DNA, 9 bp, Homo sapiens
agcagccca

SEQ ID NO: 4204958 - DNA, 10 bp, Homo sapiens
aggcaagacg

SEQ ID NO: 4204959 - DNA, 11 bp, Homo sapiens
agggaaagaat

SEQ ID NO: 4204960 - DNA, 11 bp, Homo sapiens
agggaaagaat

SEQ ID NO: 4204961 - DNA, 9 bp, Homo sapiens
attcagttg

SEQ ID NO: 4204962 - DNA, 11 bp, Homo sapiens
ctagactgaag

SEQ ID NO: 4204963 - DNA, 11 bp, Homo sapiens
ttcagagtggt

SEQ ID NO: 4204964 - DNA, 11 bp, Homo sapiens
ttcagagtggt

SEQ ID NO: 4204965 - DNA, 9 bp, Homo sapiens
agcagccca

SEQ ID NO: 4204966 - DNA, 11 bp, Homo sapiens
agtttgccttg

SEQ ID NO: 4204967 - DNA, 11 bp, Homo sapiens
atcagagggtg

SEQ ID NO: 4204968 - DNA, 10 bp, Homo sapiens
atggtgggag

SEQ ID NO: 4204969 - DNA, 9 bp, Homo sapiens
cccaggaag

SEQ ID NO: 4204970 - DNA, 10 bp, Homo sapiens
gggcagtgga

SEQ ID NO: 4204971 - DNA, 10 bp, Homo sapiens
gggcagtgga

SEQ ID NO: 4204972 - DNA, 12 bp, Homo sapiens
tcaagctcattc

SEQ ID NO: 4204973 - DNA, 9 bp, Homo sapiens
tggaaagtt

SEQ ID NO: 4204974 - DNA, 9 bp, Homo sapiens
tggagagtt

SEQ ID NO: 4204975 - DNA, 9 bp, Homo sapiens
tggagagtt

SEQ ID NO: 4204976 - DNA, 10 bp, Homo sapiens
tcactgcaac

SEQ ID NO: 4204977 - DNA, 12 bp, Homo sapiens
ccaggaagtgga

SEQ ID NO: 4204978 - DNA, 9 bp, Homo sapiens
agcctgggc

SEQ ID NO: 4204979 - DNA, 14 bp, Homo sapiens
cagcccgagcaaca

SEQ ID NO: 4204980 - DNA, 12 bp, Homo sapiens
ctccttgaggac

SEQ ID NO: 4204981 - DNA, 11 bp, Homo sapiens
cctgttgttca

SEQ ID NO: 4204982 - DNA, 8 bp, Homo sapiens
ctccacca

SEQ ID NO: 4204983 - DNA, 10 bp, Homo sapiens
gaagttcaga

SEQ ID NO: 4204984 - DNA, 7 bp, Homo sapiens
gctggaa

SEQ ID NO: 4204985 - DNA, 12 bp, Homo sapiens
ccaagaagtgga

SEQ ID NO: 4204986 - DNA, 9 bp, Homo sapiens
gggttttgt

SEQ ID NO: 4204987 - DNA, 7 bp, Homo sapiens
gaccaga

SEQ ID NO: 4204988 - DNA, 9 bp, Homo sapiens
taatgtgaa

SEQ ID NO: 4204989 - DNA, 9 bp, Homo sapiens
taatgtgag

SEQ ID NO: 4204990 - DNA, 9 bp, Homo sapiens
cccatgttt

SEQ ID NO: 4204991 - DNA, 10 bp, Homo sapiens
ctccttgagg

SEQ ID NO: 4204992 - DNA, 9 bp, Homo sapiens
taagttctg

SEQ ID NO: 4204993 - DNA, 10 bp, Homo sapiens
taagttctgc

SEQ ID NO: 4204994 - DNA, 9 bp, Homo sapiens
gaaggaagc

SEQ ID NO: 4204995 - DNA, 9 bp, Homo sapiens
taagaaaag

SEQ ID NO: 4204996 - DNA, 8 bp, Homo sapiens
ggtgctaa

SEQ ID NO: 4204997 - DNA, 11 bp, Homo sapiens
agtttgtcagt

SEQ ID NO: 4204998 - DNA, 12 bp, Homo sapiens
tggagcctgggc

SEQ ID NO: 4204999 - DNA, 7 bp, Homo sapiens
ggtccgt

SEQ ID NO: 4205000 - DNA, 7 bp, Homo sapiens
tctagac

SEQ ID NO: 4205001 - DNA, 7 bp, Homo sapiens
cactaaa

SEQ ID NO: 4205002 - DNA, 12 bp, Homo sapiens
ggttgtatggtt

SEQ ID NO: 4205003 - DNA, 10 bp, Homo sapiens
ccatattttg

SEQ ID NO: 4205004 - DNA, 11 bp, Homo sapiens
gtttgtacagt

SEQ ID NO: 4205005 - DNA, 7 bp, Homo sapiens
ctccacc

SEQ ID NO: 4205006 - DNA, 24 bp, Homo sapiens
aattgcttgaacccaggaagtgga

SEQ ID NO: 4205007 - DNA, 22 bp, Homo sapiens
actgcactccagcctgggctac

SEQ ID NO: 4205008 - DNA, 22 bp, Homo sapiens
cactgcactccagcccgagcaa

SEQ ID NO: 4205009 - DNA, 22 bp, Homo sapiens
ctagactgaagctccttgagga

SEQ ID NO: 4205010 - DNA, 22 bp, Homo sapiens
gaagtttgaagcctgttgttca

SEQ ID NO: 4205011 - DNA, 22 bp, Homo sapiens
tcactgcaacctccaccacgtg

SEQ ID NO: 4205012 - DNA, 22 bp, Homo sapiens
tctaagagaaaggaagttcaga

SEQ ID NO: 4205013 - DNA, 22 bp, Homo sapiens
gggcgtggagctggaatgatgt

SEQ ID NO: 4205014 - DNA, 22 bp, Homo sapiens
aatcacttgaacccaagaagtg

SEQ ID NO: 4205015 - DNA, 22 bp, Homo sapiens
agcaagaccagggttttgtgtt

SEQ ID NO: 4205016 - DNA, 21 bp, Homo sapiens
aggcagagaggaccagagact

SEQ ID NO: 4205017 - DNA, 22 bp, Homo sapiens
gggaaataattaatgtgaagtc

SEQ ID NO: 4205018 - DNA, 22 bp, Homo sapiens
aggaaaaaaattaatgtgagtc

SEQ ID NO: 4205019 - DNA, 18 bp, Homo sapiens
tattcatgcccatggtga

SEQ ID NO: 4205020 - DNA, 22 bp, Homo sapiens
ctggactgagctccttgaggcc

SEQ ID NO: 4205021 - DNA, 22 bp, Homo sapiens
ttctgatggttaagttctgtca

SEQ ID NO: 4205022 - DNA, 22 bp, Homo sapiens
ttcaagtgtttaagttctgctt

SEQ ID NO: 4205023 - DNA, 21 bp, Homo sapiens
aggccaagaaggaagcagagg

SEQ ID NO: 4205024 - DNA, 18 bp, Homo sapiens
agtttgtgtaagaaaagc

SEQ ID NO: 4205025 - DNA, 22 bp, Homo sapiens
attaggagagtgggtgctaagt

SEQ ID NO: 4205026 - DNA, 23 bp, Homo sapiens
tggaggagagtttgtcagtatag

SEQ ID NO: 4205027 - DNA, 22 bp, Homo sapiens
cccgggtggagcctgggctgtg

SEQ ID NO: 4205028 - DNA, 22 bp, Homo sapiens
agggcaggaggtccgtcccttc

SEQ ID NO: 4205029 - DNA, 22 bp, Homo sapiens
gtgacagtgaatctagacagac

SEQ ID NO: 4205030 - DNA, 22 bp, Homo sapiens
ctcagctcatccactaaatccc

SEQ ID NO: 4205031 - DNA, 21 bp, Homo sapiens
ggaatggtggttgtatggttg

SEQ ID NO: 4205032 - DNA, 22 bp, Homo sapiens
tgatagatccatattttggtaa

SEQ ID NO: 4205033 - DNA, 22 bp, Homo sapiens
tgggttttgtttgtacagtgta

SEQ ID NO: 4205034 - DNA, 22 bp, Homo sapiens
tcactgcaacctccaccttccg

SEQ ID NO: 4205035 - DNA, 705 bp, Homo sapiens
cccttattagaggattctgctcatgccagggtgaggtagtaagttgtattgttgtggggtagggatattaggccccaattagaagataactatacaacttactactttccctggtgtgtggcatattcacacttagtcttagcagtgttgcctccatcagacaaagttgtagatgttccttggataatttggactggaagaaaagagacatggaaggggacagatggtgtttagggtgaggcagatgtcattataaagtgacttgtctttcattaattggagcatataattattttacctttgggcatgaactcattttgctattcttcaactgtgtaatgattgcattttattagtaatagaacaggaatgtgtgcaagggaatggaaagcatactttaagaattttgggccaggcgcggtggttcatgcctgtaatcccagcatttttgggaggccgaggcgggtggatcacctgaggtcaggagttcgagaccaacctggccaacacggcgaaaccccgcctctactcaaatacaaaaattagccaggcttggtgacactcgcctgtggtcccagctactcaggaggctgaggcaggagaattgcttgaacccaggaagtggaggcttcagtgagctgagaacacgccactgcactccagtcctgggcaacagagcaagactctgtctcaggaaaaaaaaag

SEQ ID NO: 4205036 - DNA, 80 bp, Homo sapiens
gtgaggtagtaagttgtattgttgtggggtagggatattaggccccaattagaagataactatacaacttactactttcc

SEQ ID NO: 4205037 - DNA, 22 bp, Homo sapiens
tgaggtagtaagttgtattgtt

SEQ ID NO: 4205038 - DNA, 100 bp, Homo sapiens
gaggcaggagaattgcttgaacccaggaagtggaggcttcagtgagctgagaacacgccactgcactccagtcctgggcaacagagcaagactctgtctc

SEQ ID NO: 4205039 - DNA, 24 bp, Homo sapiens
aattgcttgaacccaggaagtgga

SEQ ID NO: 4205040 - DNA, 87 bp, Homo sapiens
cccgtgaggaacagtggcgggattgtcccagggccccttccagcagggggacctcctgacttgagagtccccaaagccttcccaggg

SEQ ID NO: 4205041 - DNA, 90 bp, Homo sapiens
ctccacctgtttgctagcataacaggcgtgaaggcggcagtgtcgccggcgtccttccgcggaagcccagtgtgtgcagacagcacgggg

SEQ ID NO: 4205042 - DNA, 60 bp, Homo sapiens
tgggttcctggcatgctgatttgtgacttaagattaaaatcacattgccagggattacca

SEQ ID NO: 4205043 - DNA, 126 bp, Homo sapiens
ggtcgcgctcactgcagattggagaacaggtgcatctcgtagctcttctttggaaaacaaaagaagccaccagctgaggaagatgctcaccggtcaccgtccctttatttatgcccagcgatgacc

SEQ ID NO: 4205044 - DNA, 74 bp, Homo sapiens
aggtgcaggagcttagctgattggtgaacagtgattggtttccgctttgttcacagtggctaagttctgcacct

SEQ ID NO: 4205045 - DNA, 88 bp, Homo sapiens
ctctaacaaggtgcaggagcttagctgattggtgaacagtgattggtttccgctttgttcacagtggctaagttctgcacctgaagag

SEQ ID NO: 4205046 - DNA, 81 bp, Homo sapiens
tggggacagttaagttggagccgctggggcagaggccgttgctgacgggccggccgctgctgcacagtcagcttgggtgcg

SEQ ID NO: 4205047 - DNA, 80 bp, Homo sapiens
ggtcaaatgtattgaaagttgcaaaaattcttcttacaaacataaagtgtgctgaatccactacgtaaaccaaaatcaaa

SEQ ID NO: 4205048 - DNA, 82 bp, Homo sapiens
ggctgtgagcggggcggggcggggctttcggaggagctcctgttgttctgggcgcggtgaactctctcttgtatttgcagtc

SEQ ID NO: 4205049 - DNA, 68 bp, Homo sapiens
ctccggtgcctactgagctgatatcagttctcattttacacactggctcagttcagcaggaacaggag

SEQ ID NO: 4205050 - DNA, 86 bp, Homo sapiens
tagcagctattgtgtacgcaaagcctgagtacagcctgctggtgtcatggccacgtgtgagcaggccagcgtcacacggctcgctg

SEQ ID NO: 4205051 - DNA, 9 bp, Homo sapiens
ggaaagaat

SEQ ID NO: 4205052 - DNA, 10 bp, Homo sapiens
gcaagcggcg

SEQ ID NO: 4205053 - DNA, 9 bp, Homo sapiens
ggaaagaat

SEQ ID NO: 4205054 - DNA, 9 bp, Homo sapiens
ggaaagaat

SEQ ID NO: 4205055 - DNA, 11 bp, Homo sapiens
ctttttgcctg

SEQ ID NO: 4205056 - DNA, 9 bp, Homo sapiens
ctctctggt

SEQ ID NO: 4205057 - DNA, 10 bp, Homo sapiens
gcaagaggcg

SEQ ID NO: 4205058 - DNA, 11 bp, Homo sapiens
ctctctggtta

SEQ ID NO: 4205059 - DNA, 18 bp, Homo sapiens
ggaaagaatgtgggtgca

SEQ ID NO: 4205060 - DNA, 19 bp, Homo sapiens
gcaagaggcgagaagcaga

SEQ ID NO: 4205061 - DNA, 18 bp, Homo sapiens
ggaaagaattaatgtgag

SEQ ID NO: 4205062 - DNA, 18 bp, Homo sapiens
ggaaagaattaatgtgaa

SEQ ID NO: 4205063 - DNA, 19 bp, Homo sapiens
ctttttgcctgggcagggc

SEQ ID NO: 4205064 - DNA, 20 bp, Homo sapiens
ctctctggttagtacttgga

SEQ ID NO: 4205065 - DNA, 19 bp, Homo sapiens
gcaagaggcgagaagcagt

SEQ ID NO: 4205066 - DNA, 19 bp, Homo sapiens
ctctctggttagtaatagg

SEQ ID NO: 4205067 - DNA, 20 bp, Homo sapiens
ggaaaggaaagtgggtgcac

SEQ ID NO: 4205068 - DNA, 18 bp, Homo sapiens
gcaagagtgagaagcaga

SEQ ID NO: 4205069 - DNA, 17 bp, Homo sapiens
ggaaaggataatgtgag

SEQ ID NO: 4205070 - DNA, 16 bp, Homo sapiens
ggaaagataatgtgaa

SEQ ID NO: 4205071 - DNA, 18 bp, Homo sapiens
ctttttgcagggcagggc

SEQ ID NO: 4205072 - DNA, 21 bp, Homo sapiens
ctagtctggttagtacttgga

SEQ ID NO: 4205073 - DNA, 17 bp, Homo sapiens
gcagaggcagaagcagt

SEQ ID NO: 4205074 - DNA, 19 bp, Homo sapiens
ctctctggagagtaatagg

SEQ ID NO: 4205075 - DNA, 129 bp, Homo sapiens
gacagtggcaatggggaaaggaaagtgggtgcactcaagctggcagaagtcagctaggcaagatgtgtaactggttcaacttctgcatagaggagaatgtaggtcctttccattctaatatagatgttc

SEQ ID NO: 4205076 - DNA, 103 bp, Homo sapiens
cccaggttctgcaagagtgagaagcagaaagcctactttgcgttgcctctacctgaggagaagaagccaggtgtgctctcagatggtcggggtagtgcttggg

SEQ ID NO: 4205077 - DNA, 127 bp, Homo sapiens
attcttcatgtttggctaaaagagactccaactgcttggcctctttctgaacctactattaagaggaaaggataatgtaggcaggctagtatggacctgtttactccgatttcatcaaatggagctt

SEQ ID NO: 4205078 - DNA, 126 bp, Homo sapiens
gctagagagttgagaccgagtgaaggccacacctccggagggaaagataatgtgaaggctctctccactgacatgtcacatgctttctacttgactgggcttccctaaacttgggtaattttcagc

SEQ ID NO: 4205079 - DNA, 93 bp, Homo sapiens
ctcttctaacttcagtcctttttgcagggcagggcttactctaggaaacttattgcaaggtaagtcaagtccttaaggtctggccactcagag

SEQ ID NO: 4205080 - DNA, 87 bp, Homo sapiens
agggtctagtctggttagtacttggatgagagagaccaaatagcaaatacttaaaatgtcttttctaaggaaattaaattggctcct

SEQ ID NO: 4205081 - DNA, 100 bp, Homo sapiens
tcttgccttgcactgtccataaatctgccctggctttctgcctgactgcacactaagaatcatgcacagaaagcagaggcagaagcagtgattggtaagg

SEQ ID NO: 4205082 - DNA, 104 bp, Homo sapiens
ctttgagaaaaagaggcttgttatattccaagcatgagatgattattagaaacacttattttctgttctctctggagagtaataggcataaccccttatcaggg

SEQ ID NO: 4205083 - DNA, 270 bp, Homo sapiens
aagcctcaataaagcttgccttgagtgcttcaagtagtgtgtgcccgtctgttgtgtgactctggtaactagagatccctcagacccttttagtcagtgtggaaaatctctagcagtggcgcccgaacagggacctgaaagcgaaagggaaaccagaggagctctctcgacgcaggactcggcttgctgaagcgcgcacggcaagaggcgaggggcggcgactggtgagtacgccaaaaattttgactagcggaggctagaaggagagag

SEQ ID NO: 4205084 - DNA, 57 bp, Homo sapiens
ggtctctctggttagaccagatctgagcctgggagctctctggctaactagggaacc

SEQ ID NO: 4205085 - DNA, 22 bp, Homo sapiens
gtctctctggttagaccagatc

SEQ ID NO: 4205086 - DNA, 47 bp, Homo sapiens
cgcaggactcggcttgctgaagcgcgcacggcaagaggcgaggggcg

SEQ ID NO: 4205087 - DNA, 17 bp, Homo sapiens
gcaagaggcgaggggcg

SEQ ID NO: 4205088 - DNA, 163 bp, Homo sapiens
acagggctgctattaacaagagatggtggtaatagcaacaatgagtccgagatcttcagacctggaggaggagatatgagggacaattggagaagtgaattatataaatataaagtagtaaaaattgaaccattaggagtagcacccaccaaggcaaagagaa

SEQ ID NO: 4205089 - DNA, 25 bp, Homo sapiens
tgagtccgagatcttcagacctgga

SEQ ID NO: 4205090 - DNA, 24 bp, Homo sapiens
tgagtccgagatcttcagacctgg

SEQ ID NO: 4205091 - DNA, 200 bp, Homo sapiens
tgggaagccctcaaatattggtggaatctcctacagtattggagtcaggaactaaagaatagtgctgttagcttgctcaatgccacagccatagcagtagctgaggggacagatagggttatagaagtagtacaaggagcttgtagagctattcgccacatacctagaagaataagacagggcttggaaaggattttgct

SEQ ID NO: 4205092 - DNA, 24 bp, Homo sapiens
tgaggggacagatagggttataga

SEQ ID NO: 4205093 - DNA, 24 bp, Homo sapiens
tgaggggacagatagggttataga

SEQ ID NO: 4205094 - DNA, 22 bp, Homo sapiens
tcactgcaacctccaccagcct

SEQ ID NO: 4205095 - DNA, 18 bp, Homo sapiens
attcattgcccatgtttg
